(12) United States Patent
Itzhaki et al.

(10) Patent No.: US 11,279,925 B2
(45) Date of Patent: *Mar. 22, 2022

(54) CHIMERIC PROTEINS

(71) Applicant: CAMBRIDGE ENTERPRISE LIMITED, Cambridge (GB)

(72) Inventors: Laura Itzhaki, Cambridge (GB); Alberto Perez Riba, Cambridge (GB); Pamela Rowling, Cambridge (GB); Grasilda Zenkevičiūtė, Cambridge (GB)

(73) Assignee: Cambridge Enterprise Limited, Cambridge (GB)

( * ) Notice: Subject to any disclaimer, the term of this patent is extended or adjusted under 35 U.S.C. 154(b) by 4 days.

This patent is subject to a terminal disclaimer.

(21) Appl. No.: 16/282,155

(22) Filed: Feb. 21, 2019

(65) Prior Publication Data

US 2019/0309286 A1 Oct. 10, 2019

Related U.S. Application Data

(63) Continuation-in-part of application No. PCT/EP2018/068580, filed on Jul. 9, 2018.

(30) Foreign Application Priority Data

Aug. 18, 2017 (GB) .................................. 1713316
Sep. 1, 2017 (GB) .................................. 1714038

(51) Int. Cl.
| | |
|---|---|
| C40B 50/06 | (2006.01) |
| C12N 15/10 | (2006.01) |
| C12N 15/62 | (2006.01) |
| C40B 40/10 | (2006.01) |
| C40B 30/04 | (2006.01) |

(52) U.S. Cl.
CPC ......... *C12N 15/1044* (2013.01); *C12N 15/62* (2013.01); *C40B 30/04* (2013.01); *C40B 40/10* (2013.01); *C40B 50/06* (2013.01); *C07K 2318/20* (2013.01)

(58) Field of Classification Search
None
See application file for complete search history.

(56) References Cited

FOREIGN PATENT DOCUMENTS

| | | |
|---|---|---|
| WO | 2009/100990 A1 | 8/2009 |
| WO | 2010/060748 A1 | 6/2010 |
| WO | 2019/034332 A1 | 2/2019 |

OTHER PUBLICATIONS

Abdellali, K., et al., "Fast and Accurate Discovery of Degenerate Linear Motifs in Protein Sequences," PLOS One, v. 9, No. 9, p e106081, (Sep. 2014).

(Continued)

*Primary Examiner* — Christian C Boesen
(74) *Attorney, Agent, or Firm* — Nutter McClennen & Fish LLP

(57) ABSTRACT

This invention relates to modular proteins that interact with one or more target molecules. The chimeric proteins comprise two or more repeat domains, such as tetratricopeptide repeat domains; inter-repeat loops linking the repeat domains; and one or more peptide ligands. Each peptide ligand is located in an inter-repeat loop or at the N or C terminus of the chimeric protein. The peptide ligands may include heterologous peptidyl binding motifs, such as short linear motifs (SLiMs). Chimeric proteins with various configurations and methods for their production and use are provided.

16 Claims, 32 Drawing Sheets
Specification includes a Sequence Listing.

(56) References Cited

OTHER PUBLICATIONS

Cortajarena, A., et al., "Protein Design to Understand Peptide Ligand Recognitiion by Tetratricopeptide Repeat Proteins," Protein Engineering, Design & Selection, Oxford Journal, v. 17, No. 4, pp. 399-409 (Apr. 2004).
International Search Report and Written Opinion for PCT/EP2018/068580, dated Nov. 28, 2018 (14 pages).
Jackrel M., et al., Screening Libraries to Identify Proteins With Desired Binding Activities Using a Split-GFP Reassembly Assay), ACS Chemical Biology, v. 5, No. 6, pp. 553-562 (Jun. 18, 2010).
Lee, J., et al. "Protein Grafting of p53TAD Onto a Leucine Zipper Scaffold Generates a Potent HDM Dual Inhibitor," Nature Communications, v. 5, No. 1 pp. 3-5 (May 2014).
Park, J., et al., "Regulation of Amyloid Precursor Protein Processing by Its KRERQ Motif," BMB Reports, v. 49, No. 6, pp. 337-343 (Jun. 2016).

| Composition of linker sequence in Nrf-TPR | $K_i \pm SE$ (nM) |
|---|---|
| Consensus-like | 282 ± 64 |
| Flexible | 109 ± 18 |
| Charged | 817 ± 75 |
| CIDER-optimised | 103 ± 15 |

CHIMERIC PROTEINS

This application is a continuation-in-part application of PCT/EP2018/068580, filed Jul. 9, 2018, which claims the benefit of GB1714038.5, filed Sep. 1, 2017, and GB1713316.6, filed Aug. 18, 2017, each of which is incorporated herein by reference in its entirety.

All publications cited herein are incorporated by reference herein in their entirety.

SEQUENCE LISTING

The instant application contains a Sequence Listing which has been submitted electronically in text format and is hereby incorporated by reference in its entirety. Said text copy, created on Feb. 28, 2020, is named 119691-10101_revised_seq_listing.txt and is 1,111 kb in size.

FIELD

This invention relates to chimeric proteins and their production and uses.

BACKGROUND

A priority area in medicine, particularly cancer research, is the expansion of the 'druggable' proteome, which is currently limited to narrow classes of molecular targets. For example, protein-protein interactions (PPIs) are fundamental to all biological processes and represent a large proportion of potential drug targets, but they are not readily amenable to conventional small molecule inhibition. The architecture of tandem repeat proteins has tremendous scope for rational design (Kobe & Kajava 2000, Longo & Blaber, 2014, Rowling et al., 2015). The key features of tandem repeat proteins are relatively small size, modularity and extremely high stability (and therefore recombinant production) without the need of disulphide bonds. Individual consensus-designed repeats are self-compatible and can be put together in any order; function is therefore also modular, which means that multiple functions can be independently designed and incorporated in a combinatorial fashion within a single molecule (WO2017106728).

Novel repeat protein functions, e.g. DARPins (Tamaskovic et al., 2012), have been developed based on the natural type of PPI interface of these proteins i.e. spanning many repeat units to create an extended, high-affinity binding interface for the target. Mutations have been introduced into the surface residues in the tetratricopeptide (TPR) repeats of the cytosolic receptor peroxin 5 (Sampathkumar et al. (2008) J. Mol. Biol., 381, 867-880). Binding of peptide ligands to peroxin 5 is shown to be mediated by residues located in several different TPR repeats. The interactions of TPR containing protein kinesin-1 with different cargo proteins has also been reported (Zhu et al PLoS One 2012 7 3 e33943). The specificity and stability of ankyrin repeat proteins has been modified through the introduction of mutations into ankyrin repeat sequences (Li et al (2006) Biochemistry 45 15168-15178).

SUMMARY OF THE INVENTION

The present inventors have found that chimeric proteins which comprise peptidyl ligands, such as short linear motifs (SLiMs), on scaffolds. Such chimeric proteins (i.e., modular binding proteins), may be useful for example, as single- or multi-function protein therapeutics.

An aspect of the invention provides a chimeric protein comprising:
 a scaffold comprising a first end and a second end, and two or more repeat domains linked by inter-repeat loops between the ends; and
 one or more peptide ligands, wherein a single peptide ligand is located in the scaffold in (i), an inter-repeat loop, (ii) at the first end, or (iii) at the second end of the scaffold, thereby forming a chimeric protein (a grafted scaffold).

In a preferred embodiment, the scaffold is a continuous polypeptide strand such that the first end is the N terminus and the second end is the C terminus of the scaffold.

In some preferred embodiments, the chimeric protein may comprise a first peptide ligand that binds a first target molecule and a second peptide ligand that binds a second target molecule. One of the first or second target molecules may be an E3 ubiquitin ligase. Where a chimeric protein comprises two or more peptide ligands, the ligands are different ligands (bind to different targets) and are not located in the same loop or at the same end of a scaffold.

Another aspect of the invention provides a method of producing a chimeric protein comprising;
 inserting a first nucleic acid encoding a peptide ligand into a second nucleic acid encoding a scaffold comprising two or more repeat domains linked by inter-repeat loops, to produce a chimeric nucleic acid encoding a chimeric protein as described herein; and
 expressing the chimeric nucleic acid to produce the chimeric protein.

Another aspect of the invention provides a method of producing a chimeric protein that binds to a first target molecule and a second target molecule comprising;
 providing a nucleic acid encoding a scaffold comprising two or more repeat domains linked by inter-repeat loops, and
 incorporating into the nucleic acid a first nucleotide sequence encoding a first peptide ligand that binds to a first target molecule and a second nucleotide sequence encoding a second peptide ligand that binds to a second target molecule to generate a nucleic acid encoding a chimeric protein comprising the first and second peptide ligands, wherein the peptide ligands are independently located in an inter-repeat loop or at the N or C terminus of the chimeric protein; and
 expressing the nucleic acid to produce the protein.

In some preferred embodiments, one of the first or second target molecules is an E3 ubiquitin ligase.

In another aspect, the invention provides a chimeric protein, comprising
 (i) a tetratricopeptide (TPR) scaffold comprising first and second α-helices linked by an inter-repeat loop, and,
 (ii) a first heterologous peptide that binds to a target protein, and
 (iii) a second heterologous peptide that binds to an E3 ubiquitin ligase,
wherein the first and second heterologous peptides are, independently, located in an inter-repeat loop or at the N or at the C terminus of the chimeric protein.

In a preferred embodiment, each of the first and second α-helices comprises the amino acid sequence Y-X1X2X3X4; wherein Y is an amino acid sequence shown in Tables 4 to 6 and X1, X2, X3, X4 are independently any amino acid, and optionally wherein X1 is D and/or optionally wherein X2 is P.

In another preferred embodiment, the first and second α-helices each comprise the amino acid sequence:

```
                                        (SEQ ID NO: 1)
AEAWYNLGNAYYKQGDYQKAIEYYQKALEL-X1X2X3X4;
or
                                        (SEQ ID NO: 307)
AEALNNLGNVYREQGDYQKAIEYYQKALEL-X1X2X3X4;
or
                                        (SEQ ID NO: 2)
AEAWYNLGNAYYRQGDYQRAIEYYQRALEL-X1X2X3X4;
or
                                        (SEQ ID NO: 3)
AEALNNLGNVYREQGDYQRAIEYYQRALEL-X1X2X3X4;
or
                                        (SEQ ID NO: 308)
AEALRNLGRVYRRQGRYQRAIEYYRRALEL-X1X2X3X4,
``` wherein X1, X2, X3, X4 are independently any amino acid, and optionally wherein X1 is D and/or optionally wherein X2 is P.

In another preferred embodiment, the chimeric protein comprising third, fourth and fifth TPR repeats.

The invention also provides a chimeric protein comprising
(i) a TPR scaffold comprising first and second α-helices linked by an inter-repeat loop, and,
(ii) a heterologous peptide ligand that binds an E3 ligase,
wherein the heterologous peptide is located in an inter-repeat loop or at the N or at the C terminus of the chimeric protein.

The invention also provides a chimeric protein comprising
(i) a TPR scaffold comprising first and second α-helices linked by an inter-repeat loop, and,
(ii) a heterologous peptide ligand that binds a target protein,
wherein the heterologous peptide ligand is located in an inter-repeat loop or at the N or at the C terminus of the chimeric protein.

Another aspect of the invention provides a library comprising chimeric proteins, each chimeric protein in the library comprising;
(i) two or more repeat domains,
(ii) inter-repeat loops linking the repeat domains; and
(iii) one or more peptide ligands, each the peptide ligand being located in an inter-repeat loop or at the N or C terminus of the chimeric protein,
wherein at least one amino acid residue in the peptide ligands in the library is diverse.

Another aspect of the invention provides a library comprising a first and a second sub-library of chimeric proteins, each chimeric protein in the first and second sub-libraries comprising;
(i) two or more repeat domains,
(ii) inter-repeat loops linking the repeat domains; and
(iii) a peptide ligand comprising at least one diverse amino acid residue,
wherein the peptide ligand in the chimeric proteins in the first sub-library binds to a first target molecule and is located in one of (i) an inter-repeat loop; (ii) the N terminus or (iii) the C terminus of the chimeric protein, and
the peptide ligand in the chimeric proteins in the second sub-library binds to a second target molecule and is located in another of (i) an inter-repeat loop; (ii) the N terminus or (iii) the C terminus of the chimeric protein.

Another aspect of the invention provides a method of producing a library of chimeric proteins comprising;
(a) providing a population of nucleic acids encoding a diverse population of chimeric proteins comprising
(i) two or more repeat domains,
(ii) inter-repeat loops linking the repeat domains; and
(iii) one or more peptide ligands, each the peptide ligand being located in an inter-repeat loop or at the N or C terminus of the chimeric protein,
wherein the peptide ligands in the population are diverse, and
(b) expressing the population of nucleic acids to produce the diverse population, thereby producing a library of chimeric proteins.

Another aspect of the invention provides a method of screening a library comprising;
(a) providing a library of chimeric proteins, each chimeric protein in the library comprising;
(i) two or more repeat domains,
(ii) inter-repeat loops linking the repeat domains; and
(iii) a peptide ligand located in the inter-repeat loop, at the N terminus or at the C terminus of the protein.
wherein at least one amino acid residue in the peptide ligands in the library is diverse,
(b) screening the library for chimeric proteins which display a binding activity, and
(c) identifying one or more chimeric proteins in the library which display the binding activity.

Other aspects and embodiments of the invention are described in more detail below.

Other Embodiments

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

All publications and patent applications mentioned in the specification are indicative of the level of skill of those skilled in the art to which this invention pertains. All publications and patent applications are herein incorporated by reference to the same extent as if each individual publication or patent application was specifically and individually indicated to be incorporated by reference

BRIEF DESCRIPTION OF FIGURES

FIG. 3 shows an example of helix grafting.

FIG. 4 shows another example of helix grafting.

FIG. 5 shows an example of single and multivalent loop-grafted CTPRs.

FIG. 6 shows an example of loop-grafted CTPRs comprising the 10-residue Skp2-binding sequence derived from p27 grafted into a loop of a CTPR protein (CTPR-p27).

FIG. 7 shows another example of loop-grafted CTPRs.

FIG. 9 shows the induced degradation of the target protein beta-catenin by designed hetero-bifunctional RTPRs.

DETAILED DESCRIPTION

Figure 1:
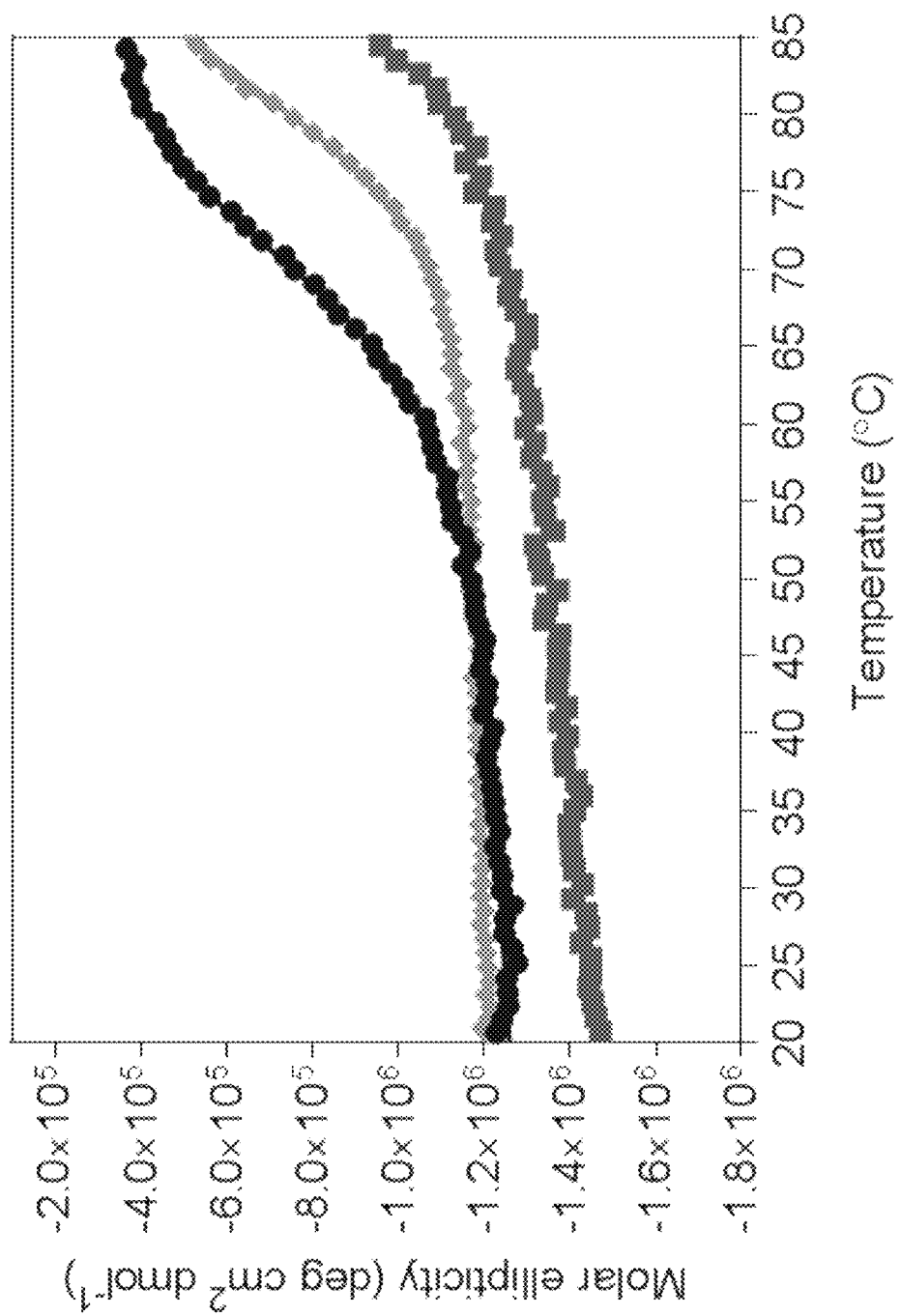
FIG. 1 shows the thermostability of consensus-designed tetratricopeptide (CTPR) proteins containing loop- or helix-grafted binding motifs: Thermal denaturation, monitored by circular dichroism, of 2-repeat RTPR (a CTPR in which lysine residues have been replaced with arginine residues) proteins: RTPR2 (in diamonds), RTPR2 containing a loop binding-module (circles) and RTPR2 containing a helix binding-module (squares). All samples are at 20 µM in 10 mM sodium phosphate buffer pH 7.4, 150 mM NaCl.

This invention relates to the chimeric proteins that comprise multiple repeat domains. These repeat domains are linked to each other in the polypeptide chain by inter-repeat loops. One or more peptide ligands (i.e., peptidyl binding motifs or binding domains), are located in one or more of the inter-repeat loops and/or in N or C terminal helices of the chimeric protein. The peptide ligands may be to the same or different target molecules and the chimeric protein may be multi-functional and/or multi-valent. The geometrical display of the grafted binding sites may be precisely and predictably tuned by adjusting the positions of the binding sites and the number and shape of the repeat domains. Chimeric proteins as described herein may be useful in a range of therapeutic and diagnostic applications.

A "repeat domain" is a repetitive structural element of 30 to 100 amino acids that forms a defined secondary structure. Multiple (two or more) repeat domains stack sequentially in a modular fashion to form a stable protein, which may for example have a solenoid or toroid structure. Repeat domains may be synthetic or may be naturally-occurring repeats from tandem repeat proteins, or variants thereof.

Due to the identical form of their building blocks, solenoid domains can only assume a limited number of shapes. Two main topologies are possible: linear (or open, generally with some degree of helical curvature) and circular (or closed). Patthy, László (2007). Protein Evolution. Wiley-Blackwell. ISBN 978-1-4051-5166-5.

If the two terminal repeats in a solenoid do not physically interact, it leads to an open or linear structure. Members of this group are frequently rod- or crescent-shaped. The number of individual repeats can range from 2 to over 50. A clear advantage of this topology is that both the N- and C-terminal ends are free to add new repeats and folds, or even remove existing ones during evolution without any gross impact on the structural stability of the entire domain. Kinch L N, Grishin N V (June 2002). Curr. Opin. Struct. Biol. 12 (3): 400-8. doi:10.1016/s0959-440x(02)00338-x. PMID 12127461. This type of domain is extremely common among extracellular segments of receptors or cell adhesion molecules. A non-exhaustive list of examples include: EGF repeats, cadherin repeats, leucine-rich repeats, HEAT repeats, ankyrin repeats, armadillo repeats, tetratricopeptide repeats, etc. Whenever a linear solenoid domain structure participates in protein-protein interactions, frequently at least 3 or more repetitive subunits form the ligand-binding sites. Thus—while individual repeats might have a (limited) ability to fold on their own—they usually cannot perform the functions of the entire domain alone.

In the case when the N- and C-terminal repeats lie in close physical contact in a solenoid domain, the result is a topologically compact, closed structure. Such domains typically display a high rotational symmetry (unlike open solenoids that only have translational symmetries), and assume a wheel-like shape. Because of the limitations of this structure, the number of individual repeats is not arbitrary. In the case of WD40 repeats (perhaps the largest family of closed solenoids) the number of repeats can range from 4 to 10 (more usually between 5 and 7). (Vogel C, Berzuini C, Bashton M, Gough J, Teichmann SA (February 2004). J. Mol. Biol. 336 (3): 809-23). Kelch repeats, beta-barrels and beta-trefoil repeats are further examples for this architecture.

A repeat domain may have the structure of a solenoid repeat. The structures of solenoid repeats are well known in the art (see for example Kobe & Kajava Trends in Biochemical Sciences 2000; 25(10):509-15). For example, a repeat domain may have an α/α or α/β$_{10}$ (helix-turn-helix or hth) structure, for example a tetratricopeptide repeat structure; α/α/α (helix-turn-helix-turn-helix or hthth) structure, for example an armadillo repeat structure; a β/β/α/α structure; a α/β or 3$_{10}$/β structure, for example a leucine rich repeat (LRR) structure; a β/β/β structure, for example, an IGF1RL, HPR or PelC repeat structure; or a β/β structure, for example a serralysin or EGF repeat structure.

A "scaffold" refers to two or more repeat domains, and a "grafted scaffold" refers to a continuous polypeptide comprising a scaffold and a heterologous binding site (e.g., a peptide ligand).

Ankyrin repeat, one of the most widely existing protein motifs in nature, consists of 30-34 amino acid residues and exclusively functions to mediate protein-protein interactions, some of which are directly involved in the development of human cancer and other diseases. Each ankyrin repeat exhibits a helix-turn-helix conformation, and strings of such tandem repeats are packed in a nearly linear array to form helix-turn-helix bundles with relatively flexible loops. The loops between adjacent Ankyrin repeats are semi-structured and therefore are quite rigid. The global structure of an ankyrin repeat protein is mainly stabilized by intra- and inter-repeat hydrophobic and hydrogen bonding interactions. The repetitive and elongated nature of ankyrin repeat proteins provides the molecular bases of the unique characteristics.

The armadillo (Arm) repeat is an approximately 40 amino acid long tandemly repeated sequence motif first identified in the *Drosophila melanogaster* segment polarity gene armadillo involved in signal transduction through wingless. Animal Arm-repeat proteins function in various processes, including intracellular signalling and cytoskeletal regulation, and include such proteins as beta-catenin, the junctional plaque protein plakoglobin, the adenomatous polyposis coli (APC) tumour suppressor protein, and the nuclear transport factor importin-alpha, amongst others [(PUBMED:9770300)].

Suitable repeat domains may include domains of the Ankyrin clan (Pfam: CL0465), such as ankyrin (PF00023), which may comprise a 30-34 amino-acid repeat composed of two beta strands and two alpha helices; domains of the leucine-rich repeat (LRR) clan (Pfam; CL0022), such as LRR1 (PF00560), which may comprise a 20-30 amino acid repeat composed of an α/β horseshoe fold; domains of the Pec Lyase-like (CL0268) clan, such as pec lyase C (PF00544), which may comprise a right handed beta helix; domains of the beta-Roll (CL0592) clan such as Haemolysin-type calcium-binding repeat (PF000353), which may comprise short repeat units (e.g. 9-mers) that form a beta-roll made up of a super-helix of beta-strand-turns of two short strands each, stabilised by $Ca^{2+}$ ions; domains of the PSI clan (CL0630), such as trefoil (PF00088); and domains of the tetratricopeptide clan (CL0020), such as TPR-1 (PR00515), which may comprise a 24 to 30, or 24 to 40, or 24 to 90 amino acid repeat composed of a helix-turn-helix.

Consensus Sequences for ANK Repeats

SMART database, see Table 10) include the following:

```
004242/1-30     NGHTALHIAASK-----------------GDEQCVKLLLEHGA------DPNA
                (SEQ ID NO: 722)

CONSENSUS/80%   .t.sslhhsh.t...................tp.phhphllp.t.......pht.

CONSENSUS/65%   pstosLphAstp..................sphphlphLlptss......shsh

CONSENSUS/50%   sGpTsLHhAsps..................sshcllchLlspus......slst
```

Consensus Sequence for ARM repeats (SMART database, see Table 11) include the following:

```
IMO2HUMANb      PND-KIQAVIDAG--VCRRLVELLM--------------------HNDYKVVSPALRA
                (SEQ ID NO: 1158)

CONSENSUS/80% pt...h..hhp.t..hl..lhphlt........................p.pl.t.shhs

CONSENSUS/65% ssp.ptphlhpts..slshLlpLLp......................pts.plhptsshs

CONSENSUS/50% ssc.sppsllcsG..slstLlpLLs......................sscsclppsAstA

IMO2HUMANb    VGNIVT (SEQ ID NO: 3100)

CONSENSUS/80% ltpls.

CONSENSUS/65% LpNlst

CONSENSUS/50% LsNlus
```

Suitable repeat domains may be identified using the PFAM database (see for example Finn et al Nucleic Acids Research (2016) Database Issue 44:D279-D285).

In some preferred embodiments, the repeat domain may have the structure of an α/α-solenoid repeat domain, such as a helix-turn-helix. A helix-turn-helix domain comprises two antiparallel α-helices of 12-45 amino acids.

Suitable helix-turn-helix domains include tetratricopeptide-like repeat domains.

Tetratricopeptide-like repeats may include domains of the TPR clan (CL0020), for example and Arm domains (see for example Armadillo; PF00514; Huber et al Cell 1997; 90: 871-882), HEAT domains (Huntingtin, EF3, PP2A, TOR1; PF02985; see for example Groves et al. Cell. 96 (1): 99-110), PPR domains (pentatricopeptide repeat PF01535; see for example Small (2000) Trends Biochem. Sci. 25 (2): 46-7), TALE domains (TAL (transcription activator-like) effector; PF03377; see for example Zhang et al Nature Biotechnology. 29 (2): 149-53) and TPR1 domains (tetratricopeptide repeat-1; PF00515; see for example Blatch et al BioEssays. 21 (11): 932-9).

Other suitable helix-turn-helix domain may be synthetic, for example DHR1 to DHR83 as disclosed in Brunette et al., Nature 2015 528 580-584.

In some preferred embodiments, the helix-turn-helix scaffold may be a tetratricopeptide repeat domain (TPR) (D'Andrea & Regan, 2003) or a variant thereof. TPR repeat domains may include naturally occurring or synthetic TPR domains. Suitable TPR repeat domains are well known in the art (see for example Parmeggiani et al., J. Mol. Biol. 427 563-575) and may have the amino acid sequence:

```
                                        (SEQ ID NO: 1)
AEAWYNLGNAYYKQGDYQKAIEYYQKALEL-X1X2 X3X4,
``` wherein $X_{1-4}$ are independently any amino acid, preferably $X_1$ and $X_2$ being D and P respectively, or may be a variant of this sequence.

Additional TPR repeat consensus sequences (SMART database, see Table 9) include the following:

```
S75991        ALTLNNIGTI YYAREDYDQA LNYYEQALSL SRAV
              (SEQ ID NO: 309)

CONSENSUS/80% XXhhXthuXh hXXXtphppA htXhppsltht XpX

CONSENSUS/65% spshhphGth hhphsphppA lphappAlpl pspX

CONSENSUS/50% spsatslGps atptucaccA lcsap+ALcl sPss
```

Other TPR repeat domain sequences are shown in Tables 4-6 and 9 below.

The grouping of amino acids to classes and class abbreviation (the key) used within consensus sequences are shown below.

| Class | Key | Residues |
|---|---|---|
| alcohol | o | S, T |
| aliphatic | l | I, L, V |
| any | . | A, C, D, E, F, G, H, I, K, L, M, N, P, Q, R, S, T, V, W, Y |
| aromatic | a | F, H, W, Y |
| charged | c | D, E, H, K, R |
| hydrophobic | h | A, C, F, G, H, I, K, L, M, R, T, V, W, Y |
| negative | − | D, E |
| polar | p | C, D, E, H, K, N, Q, R, S, T |
| positive | + | H, K, R |
| small | s | A, C, D, G, N, P, S, T, V |
| tiny | u | A, G, S |
| turnlike | t | A, C, D, E, G, H, K, N, Q, R, S, T |

Preferred TPR domains may include CTPR, RTPRa, RTPRb and KTPRb domains, for example a domain having a sequence shown in Table 4 or Table 6 or a variant of a sequence shown in Table 4 or Table 6.

In some embodiments, a TPR repeat domain may be a human TPR repeat domain, preferably a TPR repeat domain from a human protein in blood. TPR repeat domains from human blood may have reduced immunogenicity in vivo. Suitable human blood TPR repeat domains may include repeat domains from IFIT1, IFIT2 or IFIT3. Other examples of human blood repeat domains identified in the plasma proteome database are shown in Table 5.

Suitable human blood repeat domains may be identified from the plasma proteome database (Nanjappa et al Nucl Acids Res 2014 January; 42(Database issue):D959-65) for example by searching for sequences with high sequence identity to the TPR repeat domain using standard sequence analysis tools (e.g. Altschul et al Nucleic Acids Res. 25:3389-34021; Altschul et al FEBS J. 272:5101-5109).

A variant of a reference repeat domain or binding site sequence set out herein may comprise an amino acid sequence having at least 50%, at least 60%, at least 70%, at least 80%, at least 90%, at least 95%, or at least 98% sequence identity to the reference sequence. Particular amino acid sequence variants may differ from a repeat domain shown above by insertion, addition, substitution or deletion of 1 amino acid, 2, 3, 4, 5, 6, 7, 8, 9, or 10 or more than 10 amino acids. Preferred variants of a TPR repeat domain may comprise one or more conserved residues, for example, 1, 2, 3, 4, 5, 6 or more preferably all of Leu at position 7, Gly or Ala at position 8, Tyr at position 11, Ala at position 20, Ala at position 27, Leu or Ile at positions 28 and 30 and Pro at position 32.

Sequence similarity and identity are commonly defined with reference to the algorithm GAP (Wisconsin Package, Accelerys, San Diego USA). GAP uses the Needleman and Wunsch algorithm to align two complete sequences that maximizes the number of matches and minimizes the number of gaps. Generally, default parameters are used, with a gap creation penalty=12 and gap extension penalty=4. Use of GAP may be preferred but other algorithms may be used, e.g. BLAST (which uses the method of Altschul et al. (1990) *J. Mol. Biol.* 215: 405-410), FASTA (which uses the method of Pearson and Lipman (1988) *PNAS USA* 85: 2444-2448), or the Smith-Waterman algorithm (Smith and Waterman (1981) *J. Mol Biol.* 147: 195-197), or the TBLASTN program, of Altschul et al. (1990) supra, generally employing default parameters. In particular, the psi-Blast algorithm (*Nucl. Acids Res*. (1997) 3389-3402) may be used.

Sequence comparison may be made over the full-length of the relevant sequence described herein.

For example, a repeat domain may comprise one or more point mutations to facilitate grafting of hydrophobic peptide ligands. For example, aromatic residues in the repeat domain may be substituted for polar or charged residues. Suitable substitutions may be identified in a rational manner, for example using Hidden Markov plots of repeat domain sequences to identify non-aromatic residues that are found in nature in consensus aromatic positions. A suitable TPR repeat domain for grafting hydrophobic peptide ligands may have the amino acid sequence:

```
                                       (SEQ ID NO: 2)
AEAWYNLGNAYYRQGDYQRAIEYYQRALEL-X1X2 X3X4,
``` wherein $X^{1-4}$ are independently any amino acid, preferably $X_1$ and $X_2$ being D and P In some embodiments, lysine residues in the repeat domain may be replaced by arginine residues to prevent ubiquitination and subsequent degradation. This may be particularly useful when the chimeric protein comprises an E3 ubiquitin ligase-peptide ligand, for example in a proteolysis targeting chimera (PROTAC). For example, a suitable TPR repeat domain may have the amino acid sequence:

```
(SEQ ID NO: 307)
AEALNNLGNVYREQGDYQRAIEYYQRALEL-X1X2 X3X4,
``` wherein $X_1$-4 are independently any amino acid, preferably $X_1$ and $X_2$ being D and P respectively.

In preferred embodiments, the chimeric protein may comprise 2, 3, 4, 5, 6, 7, 8, 9, 10 or more than 10 repeat domains. Preferably, the chimeric protein comprises 2 to 5 repeat domains. Chimeric proteins with fewer repeat domains may display increased cell penetration. For example, a chimeric protein with 2-3 repeat domains may be useful in binding intracellular target molecule. Chimeric proteins with more repeat domains may display increased stability and functionality. For example, a chimeric protein with 4 or more repeat domains may be useful in binding extracellular target molecules. A chimeric protein with 6 or more repeat domains may be useful in producing long linear molecules for targeting or assembling extracellular complexes in bi- or multivalent formats.

In other embodiments, sufficient stability and functionality may be conferred by a single repeat domain with N and C terminal peptide ligands. For example, a chimeric protein may comprise:
(i) a repeat domain, and
(ii) peptide ligands at the N and C terminal of the repeat domain.

The repeat domains of a chimeric protein may lack binding activity i.e. the binding activity of the chimeric protein is mediated by the peptide ligands and not by residues within the repeat domains.

A "binding domain" ("peptide ligand") is a contiguous amino acid sequence that specifically binds to a target molecule. Suitable peptide ligands that are capable of grafting onto a terminal helix or inter-repeat loop are well-known in the art and include peptide sequences selected from a library, antigen epitopes, natural protein-protein interactions (helical, extended or turn-like) and short linear motifs (SLiMs). Viral SLiMs (that hijack the host machinery) may be particularly useful because they may display high binding affinities (Davey et al (2011) Trends Biochem. Sci. 36,159-169).

A suitable peptide ligand for a target molecule may be selected from a library, for example using phage or ribosome display, or identified or designed using rational approaches or computational design, for example using the crystal structure of a complex or an interaction. In some embodiments, peptide ligands may be identified in an amino acid sequence using standard sequence analysis tools (e.g. Davey et al Nucleic Acids Res. 2011 Jul. 1; 39(Web Server issue): W56-W60).

Peptide ligands may be 5 to 25 amino acids in length, preferably 8 to 15 amino acids, although in some embodiments, longer peptide ligands may be employed.

Generally in chimeric proteins of the invention, the two or more peptide ligands are 40 angstroms apart from each other, they may be 35 angstroms, 30 angstroms, 25 angstroms, 20 angstroms, 15 angstroms but no less than 10 angstroms apart. A person of skill in art can use a 3D structural software such as Chimera or Pymol to determine the minimum distances between positions for ideal positioning in three dimensional orientation.

The peptide ligands and the repeat domains of the chimeric protein are heterologous i.e. the peptide ligand is not associated with the repeat domain in naturally occurring proteins and the binding and repeat domains are artificially associated in the chimeric protein by recombinant means.

A chimeric protein described herein may comprise 1 to n+1 peptide ligands, where n is the number of repeat domains in the chimeric protein. The number of peptide ligands is determined by the required functionality and valency of the chimeric protein. For example, one peptide ligand may be suitable for a mono-functional chimeric protein and two or more peptide ligands may be suitable for a bi-functional or multi-functional chimeric protein.

Chimeric proteins may be monovalent. A target molecule may be bound by a single peptide ligand in a monovalent chimeric protein. Chimeric proteins may be multivalent. A target molecule may be bound by two or more of the same or different peptide ligands in a multivalent chimeric protein.

Chimeric proteins may be monospecific. The peptide ligands in a monospecific chimeric protein may all bind to the same target molecule, more preferably the same site or epitope of the target molecule.

Chimeric proteins may be multi-specific. The peptide ligands in a multi-specific chimeric protein may bind to different target molecules. For example, a bi-specific chimeric protein may comprise one or more peptide ligands that bind to a first target molecule and one or more peptide ligands that bind to a second target molecule and a tri-specific chimeric protein may comprise one or more peptide ligands that bind to a first target molecule, one or more peptide ligands that bind to a second target molecule and one or more peptide ligands that bind to third target molecule.

A bi-specific chimeric protein may bind to the two different target molecules concurrently. This may be useful in bringing the first and second target molecules into close proximity.

When the target molecules are located on different cells, concurrent binding of the target molecules to the chimeric protein may bring the cells into close proximity, for example to promote or enhance the interaction of the cells. For example, a chimeric protein which binds to a tumour specific antigen and a T cell antigen, such as CD3, may be useful in bringing T cells into proximity to tumour cells. When the target molecules are from different biological pathways, this may be may be useful in achieving synergistic effects and also for minimising resistance.

A tri-specific chimeric protein may bind to three different target molecules concurrently. In some embodiments, one of the target molecules may be an E3 ubiquitin ligase. For example, tri-specific chimeric protein may binding to a first target molecule from a first biological pathway and a second target molecule from a second biological pathway as well as an E3 ubiquitin ligase. This may be useful in achieving synergistic effects and also for minimising resistance.

A peptide ligand may be located in an inter-repeat loop of the chimeric protein.

An "inter-repeat binding domain" or "inter-repeat peptide ligand" may comprise 5 to 25 amino acid residues, preferably 8 to 15 amino acids. However, since there is no intrinsic restriction on the size of the inter-loop peptide ligand, longer sequences of more than 25 amino acid residues may be used in some embodiments.

In some embodiments, an unstructured peptide ligand may be inserted into an inter-repeat loop.

One or more, two or more, three or more, four or more or five or more of the inter-repeat loops in the chimeric protein may comprise peptide ligands. The peptide ligands may be located on consecutive inter-repeat loops or may have a different distribution in the inter-repeat loops of the chimeric protein. For example, inter-repeat loops comprising a peptide ligand may be separated in the modular protein by one or more, two or more, three or more or four or more inter-repeat loops which lack a peptide ligand.

A peptide ligand may be connected to an inter-repeat loop directly or via one or more additional residues or linkers. Additional residues or linkers may be useful for example when a peptide ligand requires conformational flexibility in order to bind to a target molecule, or when the amino acid residues that are adjacent to the minimal peptide ligand favourably influence the micro-environment of the binding interface.

Additional residues or linkers may be positioned at the N terminus of the peptide ligand, the C terminus of the peptide ligand, or both. For example, the sequence of an inter-repeat loop containing a peptide ligand may be $[X_{1-i}]$-$[X_{1-n}]$-$[X_{1-z}]$, where each residue denoted by X is independently any amino acid and may be the same amino acid or a different amino acid to any other residue that is also denoted by X, $[X_{1-n}]$ is the peptide ligand, n is 1 to 100, $[X_{1-i}]$ is a linker and i is independently any number between 1 to 10. In some embodiments, D may be preferred at the first position of the linker $[X_{1-i}]$, P may be preferred at the second position of linker $[X_{1-w}]$, D may be preferred at the last position of the linker $[X_{1-z}]$ and/or P may be preferred at the penultimate position of linker $[X_{1-z}]$. Examples of preferred inter-repeat loop sequences may include DP-$[X_{1-n}]$-PX (SEQ ID NO:4); DPXX-$[X_{1-n}]$-XXPX (SEQ ID NO:5); DPXX-$[X_{1-i}]$-XPXX (SEQ ID NO:6); DPXX-$[X_{1-n}]$-PXXX (SEQ ID NO:7); PXX-$[X_{1-i}]$-$[X_{1-n}]$-$[X_{1-n}]$-XXPX (SEQ ID NO:8), DPXX-$[X_{1-i}]$-$[X_{1-n}]$-$[X_{1-i}]$-XPXX (SEQ ID NO:9), DPXX-$[X_{1-i}]$-$[X_{1-n}]$-$[X_{1-w}]$-PXXX (SEQ ID NO:10), DPXX-$[X_{1-i}]$-$[X_{1-n}]$-XPXX (SEQ ID NO:11), DPXX-$[X_{1-i}]$-$[X_{1-n}]$-XPXX (SEQ ID NO:12), DPXX-$[X_{1-i}]$-$[X_{1-n}]$-XPXX (SEQ ID NO:13), DPXX-$[X_{1-n}]$-$[X_{1-i}]$-XXPX (SEQ ID NO:14), DPXX-$[X_{1-n}]$-$[X_{1-i}]$-XPXX (SEQ ID NO:15) and DPXX-$[X_{1-n}]$-$[X_{1-i}]$-PXXX (SEQ ID NO:16).

The precise sequence of the residues or linkers used to connect a peptide ligand to an inter-repeat loop depends on the peptide ligand and may be readily determined for any peptide ligand of interest using standard techniques. For example, small, non-hydrophobic amino acids, such as glycine, may be used to provide flexibility and increased spatial sampling, for example when a peptide ligand needs to adopt a specific conformation, or proline residues may be used to increase rigidity, for example, when the peptide ligands are short.

In some preferred embodiments, an inter-repeat peptide ligand may be non-hydrophobic. For example, at least 40% of the amino acids in the peptide ligand may be charged (e.g. D, E, R or K) or polar (e.g. Q, N, H, T, Y, C or W). Alternatively, the repeat domains may be modified to accommodate a hydrophobic peptide ligand, for example by replacing aromatic residues with charged or polar residues.

A peptide ligand may be located at one or both termini of the chimeric protein.

A peptide ligand may be located in a helical region of the scaffold in the chimeric protein. A helical region or "helix" is a portion of a scaffold which assumes an α-helical structure.

The precise length of a helical peptide ligand is dependent on the length of the helical region of the scaffold. In general, the helical peptide ligand is no longer than the length of the helical region of the scaffold. However, if the helical region of the scaffold is located at one or other termini or is flanked by unstructured or loosely structured residues, then it may be possible to extend it to accommodate a longer helical peptide ligand.

A helical peptide ligand may comprise 3 to 25 amino acid residues, preferably 8 to 15 amino acids in length. In some embodiments, a helical peptide ligand may comprise 3-10 or 3-12 or 3-15 or 8-10 or 8-12 or 8-13 or 8-14 or 8-15 or 3-18 or 3-20 or 3-21 or 3-22 or 3-24 or 3-25 amino acids. In some embodiments, a helical peptide ligand may comprise 3 or 4 or 5 or 6 or 7 or 8 or 9 or 10 or 11 or 12 or 13 or 14 or 15 or 16 or 17 or 18 or 19 or 20 or 21 or 22 or 23 or 24 or 25 amino acid residues.

In some embodiments, a peptide ligand located at the N or C terminus may comprise an α-helical structure and may comprise all or part of a half-repeat (i.e. all or part of a single α-helix) that stacks against an adjacent repeat domain. The α-helix of the terminal peptide ligand makes stabilising interactions with an adjacent repeat domain and is stable and folded. Only a few of the positions that structurally define an α-helix are required for the correct interfacial interaction with the adjacent repeat domain. The residues in some of these positions are defined (Tyr (i)-Ile (i+4)-Tyr (i+7)-Leu (i+11) for the N-terminal α-helix and Ala (i)-Leu (i+4)-Ala/Val (i+7) for the C-terminal helix), but the remaining positions of the α-helix may be modified to form a helical peptide ligand.

A helical peptide ligand may be located at the N terminus of the protein. The N terminal peptide ligand may be helical and may comprise all or part of the sequence $X_n$-$(X)_{15}$-$X_1X_2XX$ (SEQ ID NO:17), preferably all or part of the sequence $X_n$-XYXXXIXXYXXXLXX-$X_1X_2XX$ (SEQ ID NO:18), where each residue denoted by X is independently any amino acid and may be the same amino acid or a different amino acid to any other residue in the sequence that is also denoted by X, $X_1$ is independently any amino acid, preferably D, and $X_2$ is independently any amino acid, preferably P, and n is 0 or any number. In some embodiments, the Y, I, and/or L residues in the N terminal peptide ligand may be substituted for an amino acid residue with similar properties (i.e. a conservative substitution).

A helical peptide ligand may be located at the C terminus of the scaffold. The C terminal peptide ligand may be helical and may comprise all or part of the sequence $X_n$-$(X)_{15}$-$X_1X_2XX$, preferably all or part of the sequence $X_1X_2XX$-XXAXXXLXX[A or V]XXXXX-$X_n$, (SEQ ID NO:19) where X is independently any amino acid and may be the same amino acid or a different amino acid to any other residue in the sequence that is also denoted by X, $X_1$ is independently any amino acid, preferably D, and $X_2$ is independently any amino acid, preferably P, and n is 0 or any number. In some embodiments, the A, L and/or V residues in the C terminal peptide ligand may be substituted for an amino acid residue with similar properties (i.e. a conservative substitution).

The minimum length of the terminal peptide ligand is determined by the number of residues required to form a helix that binds to the target molecule. There is no intrinsic maximum length of the terminal peptide ligand and n may be any number.

It is within the skill in the art to graft selected residues of a peptide ligand into a helix portion of a scaffold containing a helix, and the invention contemplates this variation of grafting as an equivalent to grafting a peptide ligand itself. The residues of the peptide ligand that are in contact with the peptide ligand binding partner (the target protein) are those whose side chains are outward facing and are exposed to solvent. These residues are suitable for grafting to a helical portion of a scaffold. The residues of the scaffold helix whose side chains face inwards and pack against the rest of the scaffold should not be substituted, and this way their interactions with the rest of the scaffold are maintained. It is within the skill in the art to visualize the scaffold structure to identify which of the residues of the helix selected for grafting are facing outwards. PDB codes from any protein databank provide three dimensional co-ordinates that allow one of skill in the art to visualize the structure of the domain using programs such as PYMOL®, CHIMERA® and RASMOL®. At the same time, it is well within the skill in the art to identify residues of the helix peptide ligand that face outwards form noncovalent interactions (hydrogen bonds and/or Van der Waals and/or hydrophobic interactions) with its binding partner, using a program such as PYMOL®, CHIMERA® and RASMOL® to visualize a peptide ligand complexed with its binding partner. Helix grafting is performed by selectively replacing the outward-facing residues of the helix with corresponding outward-facing residues of the peptide ligand. The inward-facing residues of the helix are undisturbed, and hence the resultant grafted scaffold will have a grafted helix that comprises a mixture of outward facing residues derived from the helix peptide and the native inward facing residues of the helix that were undisturbed.

For instance, the following example shows a nine-residue helix peptide ligand (X1-X2-X3-X4-X5-X6-X7-X8-X9). A 3-dimensional view of the peptide ligand in complex with the target protein (using one of the above-noted programs) shows that residues X1, X2, X5, X8 and X9 (for example) of the peptide ligand interact with the target protein and thus are outward facing. Similarly, a helical portion of a given scaffold may be thirty amino acids in length (Y1-Y2-Y3-. . . -Y28-Y29-Y30). A 3-dimensional view of the scaffold shows the helical region and that residues Y3, Y4, Y6, Y7, and Y10 (for example) are inward facing and thus interact with the rest of the scaffold. One of skill in the art would recognize Y1, Y2, Y5, Y8 and Y9 as outward facing, thus identifying these residues as scaffold helical residues that may be replaced with peptide ligand outward facing residues. Therefore, peptide ligand residues X1, X2, X5, X8 and X9 are grafted to the scaffold replacing residues Y1, Y2, Y5, Y8 and Y9 with the corresponding outward facing residues peptide ligand residues X1, X2, X5, X8 and X9, thereby creating an isomorphic replacement. The resultant grafted scaffold will have a grafted helix whose sequence would include the following residues:

```
X1 X2 Y3 Y4 X5 Y6 Y7 X8 X9 (Y10-30)
```

The resulting grafted helix preserves the native hydrogen bonding within the scaffold and at the same time preserves the noncovalent interactions required for specific binding of the peptide ligand to its target protein.

The "peptide ligand" may also contain more than one consecutive set of outward facing residues to graft into the scaffold, in which case the grafted scaffold may contain invariant scaffold residues between the grafted peptide residues (e, g "X1 X2 Y3 Y4 X5 Y6 Y7 X8 X9").

A helical peptide ligand may comprise all or part of the sequence $C_1X_1X_2C_2X_3X_4C_3X_5X_6C_4$, where $X_1$ to $X_6$ are independently any amino acid and, $C_1$, $C_2$, $C_3$ and $C_4$ are A, B, C and D, respectively.

In some embodiments, a helical peptide ligand may be non-hydrophobic. For example, at least 20% of the amino acids in the peptide ligand may be charged (e.g. D, E, R or K) or polar (e.g. Q, N, H, T, Y, C or W).

In other embodiments, a peptide ligand located at the N or C terminus may comprise a non-helical structure. For example, a peptide ligand that is an obligate N- or C-terminal domain (for example because the terminal amino or carboxylate group mediates the binding interaction) may be located at the beginning or end of the one or more repeat domains.

In some embodiments, one or more positions in a peptide ligand may be diverse or randomised. A chimeric protein comprising one or more diverse or randomised residues may form a library as described below.

In some embodiments, the N and C terminal peptide ligands may be non-hydrophobic. For example, at least 20% of the amino acids in the peptide ligand may be charged (e.g. D, E, R or K) or polar (e.g. Q, N, H, T, Y, C or W). Alternatively, the helix turn helix scaffold of the repeat domains may be modified, for example by replacing aromatic residues with charged or polar residues in order to accommodate a hydrophobic peptide ligand.

A chimeric protein as described herein may comprise peptide ligands in any arrangement or combination. For example, peptide ligands may be located at both the N and C terminus and optionally one or more inter-repeat loops of a chimeric protein; at the N terminus and optionally one or more loops of a chimeric protein; at the C terminus and optionally one or more loops of a chimeric protein; or in one or more inter-repeat loops of a chimeric protein.

The location of the peptide ligands within a chimeric protein may be determined by rational design, for example using modelling to identify the optimal arrangement for the presentation of two target molecules to each other (e.g. for substrate presentation to an E3 ubiquitin ligase); and/or by screening for example using populations of chimeric proteins with different arrangements of peptide ligands to identify the arrangement which confers the optimal interaction of target molecules.

Target Proteins and Targeting Peptide Ligands

Target proteins and peptide ligands that bind such proteins are described herein and are listed, without limitation, in the tables.

Suitable target molecules for chimeric proteins described herein include biological macromolecules, such as proteins. The target molecule may be a receptor, enzyme, antigen, oligosaccharide, oligonucleotide, integral membrane protein, transcription factor, transcriptional regulator, G protein coupled receptor (GPCR) or any other target of interest. Proteins that are difficult to target with small molecules, such as PPIs, proteins that accumulate in neurodegenerative diseases and proteins overexpressed in disease conditions, such as cancer, may be particularly suitable target molecules. Target molecules may include α-synuclein; β-amyloid; tau; superoxide dismutase; huntingtin; β-catenin; KRAS; components of superenhancers and other types of transcriptional regulators, such as N-Myc, C-Myc, Notch, aurora A, EWS-FLI1 (Ewing's sarcoma-friend leukemia integration 1), TEL-AML1, TAL1 (T-cell acute lymphocytic leukemia protein 1) and Sox2 ((sex determining region Y)-box 2); tankyrases; phosphatases such as PP2A; epigenetic writers, readers and erasers, such as histone deacetylases and histone methyltransferases; BRD4 and other bromodomain proteins; and kinases, such as PLK1 (polo-like kinase 1), c-ABL (Abelson murine leukemia viral oncogene homolog 1) and BCR (breakpoint cluster region)-ABL.

In some embodiments, a chimeric protein may neutralise a biological activity of the target molecule, for example by inhibiting or antagonising its activity or binding to another molecule or by tagging it for ubiquitination and proteasomal degradation or for degradation via autophagy. In other embodiments, a chimeric protein may activate a biological activity of the target molecule.

In some embodiments, the target molecule may be β-catenin. Suitable peptide ligands that specifically bind to β-catenin are well-known in the art and include β-catenin-peptide ligands derived from axin (e.g. GAYPEYIL-DIHVYRVQLEL (SEQ ID NO:20) and variants thereof), Bcl-9 (e.g. SQEQLEHRYRSLITLYDIQLML (SEQ ID NO:21) and variants thereof), TCF7L2 (e.g. QELGDN-DELMHFSYESTQD (SEQ ID NO:22) and variants thereof), ICAT (e.g. YAYQRAIVEYMLRLMS (SEQ ID NO:23) and variants thereof), LRH-1 (e.g. YEQAIAAY-LDALMC (SEQ ID NO:24) and variants thereof) or APC (e.g. SCSEELEALEALELDE (SEQ ID NO:25) and variants thereof).

In some embodiments, the target molecule may be KRAS. Suitable peptide ligands that specifically bind to KRAS are well-known in the art and include a KRAS-peptide ligand from SOS-1 (e.g. FEGIALTNYLKALEG (SEQ ID NO:26) and variants thereof) and KRAS-peptide ligands identified by phage display (see for example Sakamoto et al. Biochem. Biophys. Res. Comm. (2017) 484 605-611).

In some embodiments, the target molecule may be tankyrase. Suitable peptide ligands that specifically bind to tankyrase are well-known in the art and include tankyrase peptide ligands from Axin (e.g. REAGDGEE (SEQ ID NO:27) and HLQREAGDGEEFRS (SEQ ID NO:28) or variants thereof).

In some embodiments, the target molecule may be EWS-FLI1. Suitable peptide ligands that specifically bind to EWS-FLI1 are well-known in the art and include the ESAP1 peptide TMRGKKKRTRAN (SEQ ID NO:29) and variants thereof. Other suitable sequences may be identified by phage display (see for example Erkizan et al. Cell Cycle (2011) 10, 3397-408).

In some embodiments, the target molecule may be Aurora-A. Suitable peptide ligands that specifically bind to Aurora-A are well-known in the art and include Aurora-A binding sequences from TPX2, such as SYSYDAPSD-FINFSS (SEQ ID NO:30) (Bayliss et al. Mol. Cell (2003) 12, 851-62) and Aurora-A binding sequences from N-myc, such as N-myc residues 19-47 or 61-89 (see for example Richards et al. PNAS (2016) 113, 13726-31).

In some embodiments, the target molecule may be N-Myc or C-Myc. Suitable peptide ligands that specifically bind to N-myc or C-myc are well-known in the art and include helical binding sequences from Aurora-A (see for example Richards et al. PNAS (2016) 113, 13726-31).

In some embodiments, the target molecule may be WDR5 (WD repeat-containing protein 5). Suitable peptide ligands that specifically bind to WDR5 are well-known in the art and include the WDR5-interacting motif (WIN) of MLL1 (mixed lineage leukemia protein 1) (see for example Song & Kingston J. Biol. Chem. (2008) 283, 35258-64; Patel et al. J. Biol. Chem. (2008) 283, 32158-61), e.g. EPPLNPHGS-ARAEVHLRKS (SEQ ID NO:31) and variants thereof.

In some embodiments, the target molecule may be BRD4 or a Bromodomain protein. Suitable peptide ligands that specifically bind to BRD4 are well-known in the art and include sequences derived from histone protein ligands.

In some embodiments, the target molecule may be a HDAC (histone deacetylase). Suitable peptide ligands that specifically bind to HDAC are well-known in the art and include binding sequences derived from SMRT and other proteins that recruit HDACs to specific transcriptional regulatory complexes or binding sequences derived from histone proteins (see for example Watson et al. Nat. Comm. (2016) 7, 11262; Dowling et al. Biochem. (2008) 47, 13554-63).

In some embodiments, the target molecule may be Notch. Suitable peptide ligands that specifically bind to Notch are well-known in the art and include binding sequences from the N-terminus of MAML1 (mastermind like protein 1), e.g. SAVMERLRRRIELCRRHHST (SEQ ID NO:32) and variants thereof (see for example Moellering et al. Nature (2009) 462, 182-8).

In some embodiments, the target molecule may be a Cdk (cyclin-dependent kinase). Suitable peptide ligands that specifically bind to Cdks are well-known in the art and include substrate-based peptides, for example, Cdk2 sequences derived from cyclin A, such as TYTKKQVLR-MEHLVLKVLTFDL (SEQ ID NO:33) and variants thereof (see for example Gondeau et al. J. Biol. Chem. (2005) 280, 13793-800; Mendoza et al. Cancer Res. (2003) 63, 1020-4).

In some embodiments, the target molecule may be PLK1 (polo-like kinase 1). Suitable peptide ligands that specifically bind to PLK1 are well-known in the art and include optimised substrate-derived sequences that bind to the substrate-binding PBD (polo-box domain), such as MAGPMQSEPLMGAKK (SEQ ID NO:34) and variants thereof.

In some embodiments, the target molecule may be Tau. Suitable peptide ligands that specifically bind to Tau are well-known in the art and include tau-binding sequences derived from alpha- and beta-tubulin, such as KDY-EEVGVDSVE (SEQ ID NO:35) and YQQYQDATADEQG (SEQ ID NO:36) and variants thereof (see for example Maccioni et al. EMBO J. (1988) 7, 1957-63; Rivas et al. PNAS (1988) 85, 6092-6).

In some embodiments, the target molecule may be BCR-ABL. Suitable peptide ligands that specifically bind to BCR-ABL are well-known in the art and include optimized substrate-derived sequences, such as EAIYAAPFAKKK (SEQ ID NO:37) and variants thereof.

In some embodiments, the target molecule may be PP2A (protein phosphatase 2A). Suitable peptide ligands that specifically bind to PP2A are well-known in the art and include sequences that bind the B56 regulatory subunit, such as LQTIQEEE (SEQ ID NO:38) and variants thereof (see for example Hetz et al. Mol. Cell (2016), 63 686-95).

In some embodiments, the target molecule may be EED (Embryonic ectoderm development). Suitable peptide ligands that specifically bind to EED are well-known in the art and include helical binding sequences from co-factor EZH2 (enhancer of zeste homolog 2), such as FSSNRQKIL-ERTEILNQEWKQRRIQPV (SEQ ID NO:39) and variants thereof (see for example Kim et al. Nat. Chem. Biol. (2013) 9, 643-50.)

In some embodiments, the target molecule may be MCL-1 (induced myeloid leukemia cell differentiation protein).

Suitable peptide ligands that specifically bind to MCL-1 are well-known in the art and include sequences from BCL2, e.g. KALETLRRVGDGVQRNHETAF (SEQ ID NO:40) and variants thereof (see for example Stewart et al. Nat. Chem. Biol. (2010) 6, 595-601).

In some embodiments, the target molecule may be RAS. Suitable RAS peptide ligands are well-known in the art and include RAS-binding peptides identified by phage display, such as RRRRCPLYISYDPVCRRRR (SEQ ID NO:41) and variants thereof (see for example Sakamoto et al. BBRC (2017) 484, 605-11).

In some embodiments, the target molecule may be GSK3 (glycogen synthase kinase 3). Suitable GSK3 peptide ligands are well-known in the art and include substrate-competitive binding sequences such as KEAPPAPPQDP (SEQ ID NO:42), LSRRPDYR (SEQ ID NO:1436), RREGGMSRPADVDG (SEQ ID NO:44), and YRRAAVPPSPSLSRHSSPSQDEDEEE (SEQ ID NO:45) and variants thereof (see for example Ilouz et al. J. Biol. Chem. 281 (2006), 30621-30630. Plotkin et al. J. Pharmacol. Exp. Ther. (2003) 305, 974-980).

In some embodiments, the target molecule may be CtBP (C-terminal binding protein). Suitable CtBP peptide ligands are well-known in the art and include sequences identified from a cyclic peptide library screen, such as SGWTVVRMY (SEQ ID NO:46) and variants thereof (see for example Birts et al. Chem. Sci. (2013) 4, 3046-57).

Examples of suitable peptide ligands for target molecules that may be used in a chimeric protein as described herein are shown in Tables 2 and 7.

E3 Ligase Peptide Ligands

In some preferred embodiments, a chimeric protein as described herein may comprise a peptide ligand for an E3 ubiquitin ligase. Examples of suitable E3 ubiquitin ligases include MDM2, SCF$^{Skp2}$, BTB-CUL3-RBX1, APC/C, SIAH, CHIP, Cul4-DDB1, SCF-family, β-TrCP, Fbw7 and Fbx4.

E3 Ligase Peptide Ligands

Suitable peptide ligands for E3 ubiquitin ligases (degrons) are well known in the art and may be 5 to 20 amino acids. For example, a suitable peptide ligand for MDM2 may include a peptide ligand from p53 (e.g. FAAYWNLLSAYG) (SEQ ID NO:47) and or a variant thereof. A suitable peptide ligand for SCF$^{Skp2}$ may include a peptide ligand from p27 (e.g. AGSNEQEPKKRS) (SEQ ID NO:48) and variants thereof. A suitable peptide ligand for Keap1-Cul3 may include a peptide ligand from Nrf2 (e.g. DPETGEL) (SEQ ID NO:49) or a variant thereof. A suitable peptide ligand for SPOP-Cul3 may be include a peptide ligand from Puc (e.g. LACDEVTSTTSSSTA (SEQ ID NO:50) or a variant thereof. A suitable peptide ligand for APC/C may include the degrons termed ABBA (e.g. SLSSAFHVFEDGNKEN) (SEQ ID NO:51), KEN (e.g. SEDKENVPP) (SEQ ID NO:52), or DBOX (e.g. PRLPLGDVSNN) (SEQ ID NO:53) or a variant thereof. In some instances, a combination of these degrons for may be used (mimicking the bipartite or tripartite degrons found in some natural substrates). A suitable peptide ligand for SIAH may include a peptide ligand from PHYL (e.g. LRPVAMVRPTV) (SEQ ID NO:54) or a variant thereof. A suitable peptide ligand for CHIP (carboxyl terminus of Hsc70-interacting protein) may include peptide sequences such as ASRMEEVD (SEQ ID NO:55) (from Hsp90 C-terminus) and GPTIEEVD (SEQ ID NO:56) (from Hsp70 C-terminus) or a variant thereof. A suitable peptide ligand for beta-TrCP may include a degron sequence motif (including phosphomimetic amino acids), such as DDGYFD (SEQ ID NO:57) or a variant thereof. A suitable peptide ligand for Fbx4 may include sequences derived from TRF1, such as MPIFWKAHRMSKMGTG (SEQ ID NO:58) or a variant thereof (see for example Lee et al. Chembiochem (2013) 14, 445-451). A suitable peptide ligand for FBw7 may include degron sequence motifs (including phosphomimetic amino acids), such as LPSGLLEPPQD (SEQ ID NO:59). A suitable peptide ligand for DDB1-Cul4 may include sequences derived from HBx (hepatitis B virus X protein) and similar proteins from other viruses and from DCAFs (DDB1-CUL4-associated factors) including helical motifs such as ILPKVLHKRTLGL (SEQ ID NO:60), NFVSWHANRQLGM (SEQ ID NO:61), NTVEYFTSQQVTG (SEQ ID NO:62), and NITRDLIRRQIKE (SEQ ID NO:63) (see for example Li et al. Nat. Struct. Mol. Biol. (2010) 17, 105-111).

E3 Ligases and E3 Ligase Peptide Ligands

Examples of suitable peptide ligands for E3 ubiquitin ligases that may be used in a chimeric protein as described herein are shown in Table 3.

A chimeric protein comprising a peptide ligand for an E3 ubiquitin ligase may also comprise a peptide ligand for a target molecule. Without being bound to any one hypothesis, binding of the chimeric protein to both the target molecule and the E3 ubiquitin ligase may cause the target molecule to be ubiquitinated by the E3 ubiquitin ligase. Ubiquitinylated target molecules may then degraded by the proteasome. This allows the specific targeting of molecules for proteolysis by the chimeric protein. The ubiquitination and subsequent degradation of a target protein has been shown for heterobifunctional small molecules (PROTACs; proteolysis targeting chimeras) that bind the target protein and a ubiquitin ligase simultaneously (see for example Bondeson et al. Nat. Chem. Biol. 2015; Deshaies 2015; Lu et al. 2015).

In some embodiments, the chimeric protein may lack lysine residues, so that it avoids ubiquitination by the E3 ubiquitin ligase.

Examples of chimeric proteins that bind E3 ubiquitin ligase and a target molecule are shown in Tables 1 and 8.

Figure 10A:
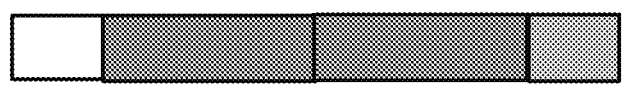
FIG. 10 shows examples of different chimeric protein formats. A chimeric protein may comprise: two repeat domains with a helical target-binding peptide and a helical E3-binding peptide at the N and C termini (FIG. 10A); three repeat domains with a helical E3-binding peptide at the C terminus and a target peptide ligand in the first inter-repeat loop from the N terminus (FIG. 10B); three repeat domains with a helical target-binding peptide at the N terminus and an E3 peptide ligand in the second inter-repeat loop from the N terminus (FIG. 10C), four repeat domains with a target-peptide ligand and an E3 peptide ligand in the first and third inter-repeat loop from the N terminus (FIG. 10D).

A suitable chimeric protein may comprise an N terminal peptide ligand that binds a target protein, such as β catenin, and a C terminal peptide ligand that binds an E3 ubiquitin ligase. For example, the N terminal peptide ligand may be a β catenin-binding sequence derived from Bcl9 and the C terminal peptide ligand may be an Mdm2-binding sequence derived from p53. Alternatively, a chimeric protein may comprise a C terminal peptide ligand that binds a target protein, such as β catenin, and an N terminal peptide ligand that binds an E3 ubiquitin ligase (see FIG. 10A).

Figure 10B:

Another suitable chimeric protein may comprise three repeat domains, a peptide ligand located in an inter-repeat loop that binds a target protein, such as β catenin, and a C terminal peptide ligand that binds an E3 ubiquitin ligase. For example, the inter-repeat loop peptide ligand may be derived from the phosphorylated region of APC (adenomentous polyposis coli) and the C terminal peptide ligand may be an Mdm2-binding sequence derived from p53. Alternatively, the chimeric protein may comprise a peptide ligand located in an inter-repeat loop that binds an E3 ubiquitin ligase, and a C terminal peptide ligand that binds a target protein, such as β catenin (See FIG. 10B).

Figure 10C:
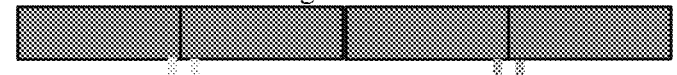
Figure 10D:
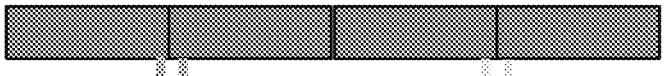
Figure 11:
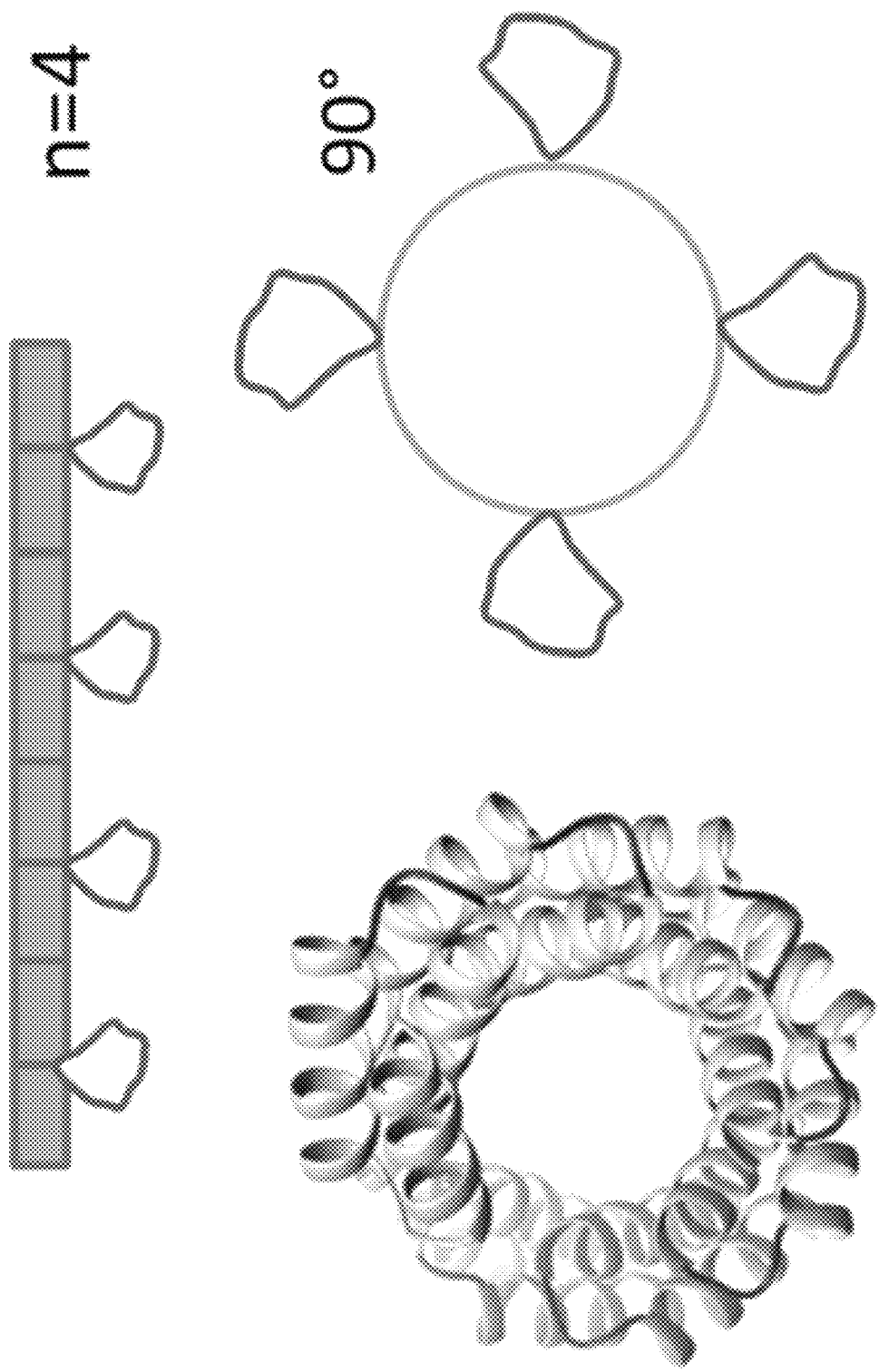
FIG. 11 shows a schematic of a chimeric protein with four peptide ligands located in alternate inter-repeat loops. The binding sites are arrayed at 90° to each other.
Figure 12:
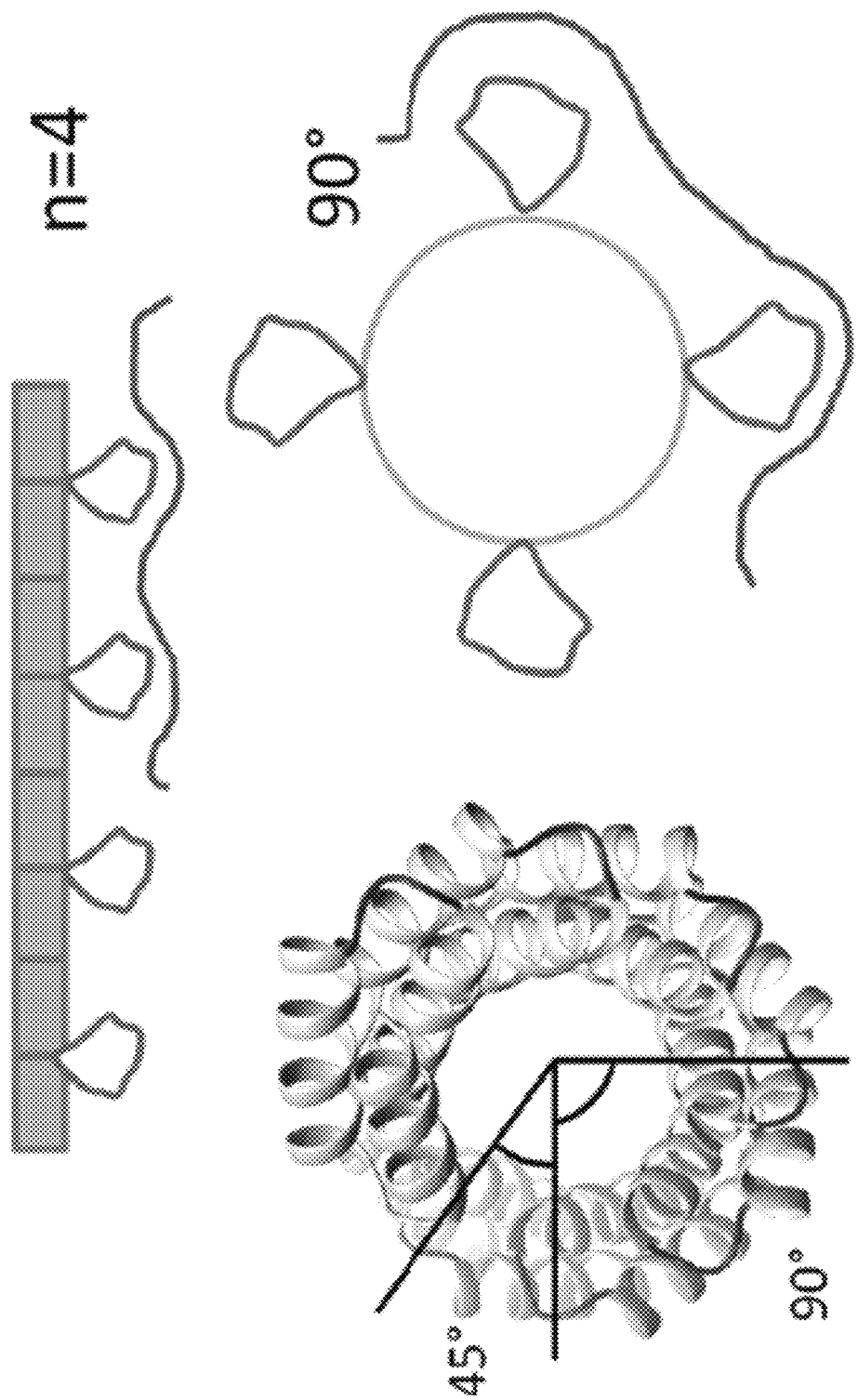
FIG. 12 shows a schematic of a chimeric protein engineered so that peptide ligands in alternate inter-repeat loops bind adjacent epitopes on the target.
Figure 13:
FIG. 13 shows the modelled structure of a hetero-bifunctional chimeric protein comprising TPR repeat domains, an LRH1-derived peptide ligand designed to bind target beta-catenin, and a p53-derived N-terminal peptide ligand designed to bind to the E3 ubiquitin ligase mdm2.
Figure 14:
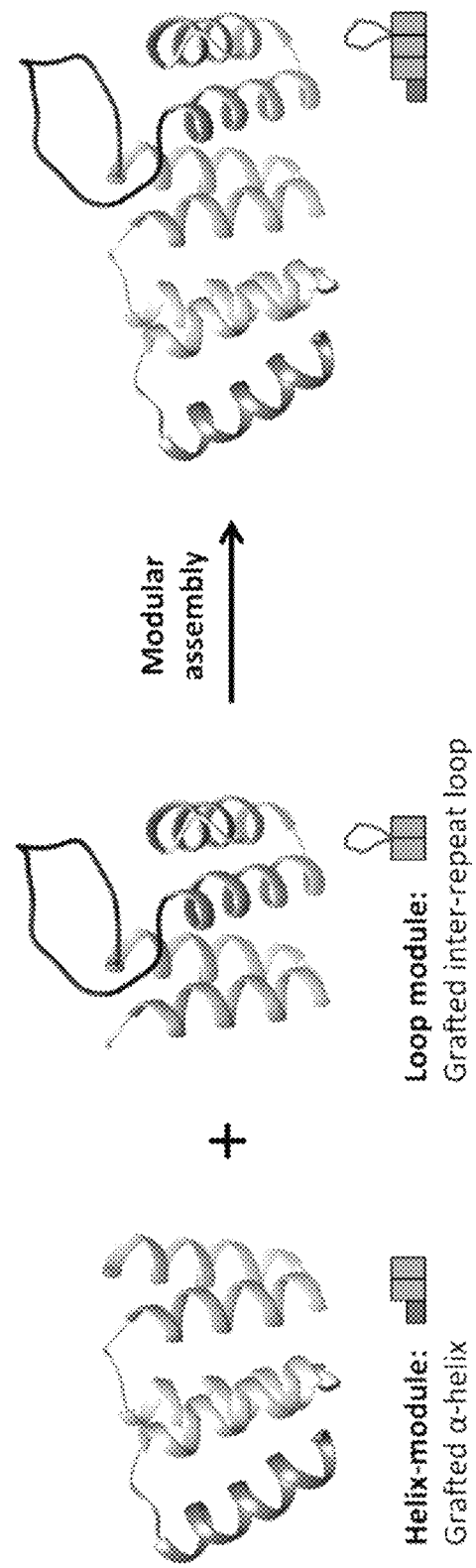
FIG. 14 shows a schematic of the combinatorial assembly of a module comprising a repeat domain and a terminal helical peptide ligand and a module comprising repeat domains and an inter-repeat loop peptide ligand to generate a chimeric protein.
Figure 15:
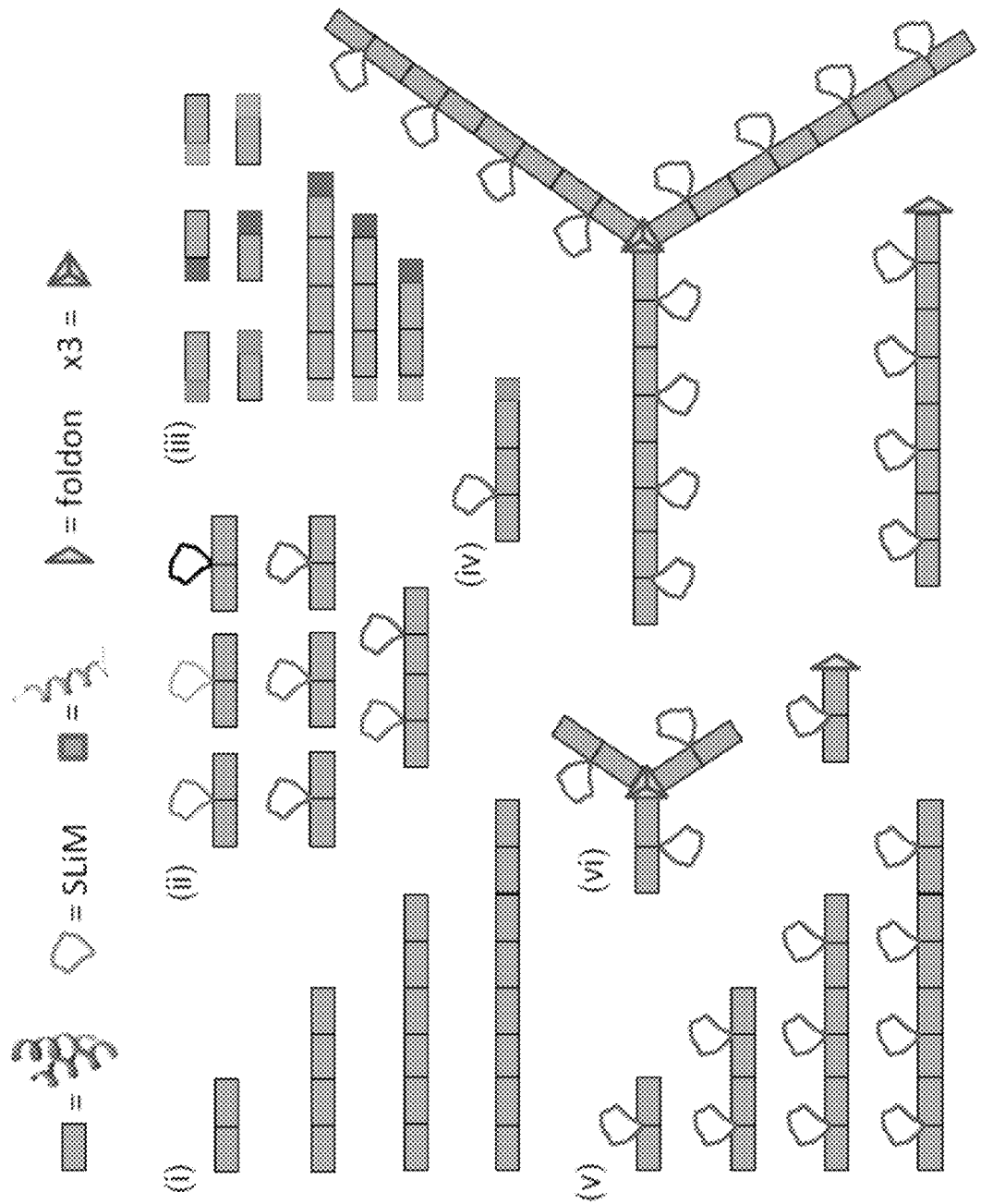
FIG. 15 shows examples of different chimeric protein formats. (i) shows the blank proteins; (ii) shows binding peptides inserted into one or more inter-repeat loops. (iii) shows helical binding peptides at one or both of the termini; (iv) is a combination of loop and helical binding peptides; (v) and (vi) show examples of how multivalency can be achieved.

Another suitable chimeric protein may comprise three repeat domains, an N terminal peptide ligand that binds a target protein, such as β catenin, and a peptide ligand located in an inter-module loop that binds an E3 ubiquitin ligase. For example, the N terminal peptide ligand may be a β catenin-binding sequence derived from LRH1 (liver receptor homolog 1) and the inter-module loop peptide ligand may be a sequence derived from the Skp2-targeting region of p27. Alternatively, the chimeric protein may comprise an N terminal peptide ligand that binds an E3 ubiquitin ligase and a peptide ligand located in an inter-module loop that binds a target protein, such as β catenin (see FIG. 10C).

Another suitable chimeric protein may comprise four repeat domains, a first peptide ligand located in an inter-repeat loop that binds an E3 ubiquitin ligase and a second peptide ligand located in an inter-repeat loop that binds a target molecule. The first and second inter-repeat loops may be separate by an inter-repeat loop lacking a peptide ligand. For example, the first peptide ligand may be located in the first inter-repeat loop inter-repeat loop from the N terminus and the second peptide ligand may be located in the third inter-repeat loop from the N terminus or vice versa.

In some preferred embodiments, a chimeric protein as described herein may comprise an amino acid shown in Table 8 or a variant thereof.

In other preferred embodiments, a chimeric protein as described herein may comprise a peptide ligand that binds to a component of a target-selective autophagy pathway, such as chaperone-mediated autophagy (CMA). The chimeric protein and target molecules bound thereto are thus recognised by the autophagy pathway and the target molecules are subsequently degraded. Suitable components of the CMA pathway include heat shock cognate protein of 70 kDa (hsc70, HSPA8, Gene ID: 3312). Suitable peptide ligands are well known in the art (Dice J. F. (1990). Trends Biochem. Sci. 15, 305-309) and include Lys-Phe-Glu-Arg-Gln (KFERQ (SEQ ID NO:64)) and variants thereof, such as CMA_Q and CMA_K, as described herein. These domains have been demonstrated to be capable of targeting heterologous proteins to the autophagy pathway (Fan, X. et al; (2014) Nature Neuroscience 17, 471-480).

In addition to repeat domains and peptide ligands, a chimeric protein may further comprise one or more additional domains which confer additional functionality, such as targeting domains, intracellular transport domains, stabilising domains or oligomerisation domains. Additional domains may for example be located at the N or C terminus of the chimeric protein or in a loop between repeats.

A targeting domain may be useful in targeting the chimeric protein to a particular destination in vivo, such as a target tissue, cell, membrane or intracellular organelle. Suitable targeting domains include chimeric antigen receptors (CARs).

An intracellular transport domain may facilitate the passage of the chimeric protein through the cell membrane into cells, for example to bind intracellular target molecules. Suitable intracellular transfer domains are well known in the art (see for example Bechara et al FEBS Letters 587 1 (2013) 1693-1702) and include cell-penetrating peptides (CPPs), such as Antennapedia (43-58), Tat (48-60), Cadherin (615-632) and poly-Arg.

A stabilising domain may increase the half-life of the chimeric protein in vivo. Suitable stabilising domains are well known in the art and include Fc domains, serum albumin, unstructured peptides such as XTEN[98] or PAS[99] and polyethylene glycol (PEG).

An oligomerisation domain may facilitate the formation of multi-protein complexes, for example to increase avidity against multi-valent targets. Suitable oligomerisation domains include the 'foldon' domain, the natural trimerisation domain of T4 fibritin (Meier et al., J. Mol. Biol. (2004) 344(4):1051-69).

In addition to repeat domains, peptide ligands and optionally one or more additional domains, a chimeric protein may further comprise a cytotoxic or therapeutic agent and/or or detectable label.

Suitable cytotoxic agents include, for example, chemotherapeutic agents, such as methotrexate, auristatin adriamicin, doxorubicin, melphalan, mitomycin C, ozogamicin, chlorambucil, maytansine, emtansine, daunorubicin or other intercalating agents, enzymatically active toxins of bacterial, fungal, plant, or animal origin, such as diphtheria A chain, nonbinding active fragments of diphtheria toxin, exotoxin A chain, ricin A chain, abrin A chain, modeccin A chain, α-amanitin, alpha-sarcin, *Aleurites fordii* proteins, tubulysins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, pyrrolobenzodiazepines, and the tricothecenes and fragments of any of these. Suitable cytotoxic agents may also include radioisotopes. A variety of radionuclides are available for the production of radioconjugated chimeric proteins including, but not limited to, $^{90}$Y, $^{125}$I, $^{131}$I, $^{123}$I, $^{111}$In, $^{131}$In, $^{105}$Rh, $^{153}$Sm, $^{67}$Cu, $^{67}$Ga, $^{166}$Ho, $^{177}$Lu, $^{196}$Re, $^{188}$Re and $^{212}$Bi. Conjugates of a chimeric protein and one or more small anti-cancer molecules, for example toxins, such as a calicheamicin, maytansinoids, a trichothene, and CC1065, and the derivatives of these toxins that have toxin activity, may also be used.

Suitable therapeutic agents may include cytokines (e.g. IL2, IL12 and TNF), chemokines, pro-coagulant factors (e.g. tissue factor), enzymes, liposomes, and immune response factors.

A detectable label may be any molecule that produces or can be induced to produce a signal, including but not limited to fluorescers, radiolabels, enzymes, chemiluminescers or photosensitizers. Thus, binding may be detected and/or measured by detecting fluorescence or luminescence, radioactivity, enzyme activity or light absorbance. Detectable labels may be attached to chimeric proteins using conventional chemistry known in the art.

There are numerous methods by which the label can produce a signal detectable by external means, for example, by visual examination, electromagnetic radiation, heat, and chemical reagents. The label can also be bound to another specific binding member that binds the chimeric protein, or to a support.

In some embodiments, a chimeric protein may be configured for display on a particle or molecular complex, such as a cell, ribosome or phage, for example for screening and selection. A suitable chimeric protein may further comprise a display moiety, such as phage coat protein, to facilitate display on a particle or molecular complex. The phage coat protein may be fused or covalently linked to the chimeric protein.

Providing a Chimeric Protein According to the Invention

Chimeric proteins as described herein may be produced by recombinant means. For example, a method of producing a chimeric protein as described herein may comprise expressing a nucleic acid encoding the chimeric protein. A nucleic acid may be expressed in a host cell and the expressed chimeric protein may then be isolated and/or purified from the cell culture.

In some embodiments, the recombinant method may comprise;
inserting a first nucleic acid encoding a peptide ligand into a second nucleic acid encoding two or more repeat domains, e.g, a TPR repeat as described herein, e.g., CTPR or RTPR2, to produce a chimeric nucleic acid encoding a chimeric protein comprising a peptide ligand. The first nucleic acid may be inserted into an inter-repeat loop (for example, the RTPR2 scaffold contains a 20 amino acid loop and the first peptide ligand may be inserted anywhere between codons encoding two loop amino acids. Alternatively, the first nucleic acid may be inserted into the second nucleic acid at the codon encoding the N-terminus or the C-terminus of the scaffold such that the peptide is in-frame with the scaffold, thereby forming a chimeric nucleic acid encoding a chimeric protein (a grafted scaffold).; and, expressing the chimeric nucleic acid to produce the chimeric protein.

Methods described herein may be useful in producing a chimeric protein that binds to a first target molecule and a second target molecule. For example, a method may comprise;

providing a nucleic acid encoding two or more repeat domains linked by inter-repeat loops, each repeat domain; and incorporating into the nucleic acid a first nucleotide sequence encoding a first peptide ligand that binds to a first target molecule and a second nucleotide sequence encoding a second peptide ligand that binds to a second target molecule to generate a nucleic acid encoding a chimeric protein comprising the first and second peptide ligands, wherein the first nucleotide sequence encoding the first peptide ligand is located in an inter-repeat loop or at the N or C terminus of the grafted scaffold and the second nucleotide sequence encoding the second peptide ligand is located in a different inter-repeat loop than the first peptide ligand or is located at the N or C terminus wherein the first peptide ligand is not located; and expressing the nucleic acid to produce the chimeric protein.

One of the first and second target molecules may be an E3 ubiquitin ligase. For example, a method may comprise;

providing a nucleic acid encoding two or more repeat domains linked by inter-repeat loops between the repeat domains; and incorporating into the nucleic acid a first nucleotide sequence encoding a first peptide ligand that binds to a target molecule and a second nucleotide sequence encoding a second peptide ligand that binds to an E3 ubiquitin ligase to generate a nucleic acid encoding a chimeric protein comprising the first and second peptide ligands, wherein the first and second peptide ligands are located (i) in different inter-repeat loops or (ii) the first ligand is located in an inter-repeat loop while the second peptide ligand is located at the N or C terminus of the scaffold, or (iii) the first and second peptide ligands are located at the N and C termini of the scaffold, respectively; and expressing the nucleic acid to produce the protein.

An isolated nucleic acid encoding a chimeric protein as described herein is provided as an aspect of the invention. The nucleic acid may be comprised within an expression vector. Suitable vectors can be chosen or constructed, containing appropriate regulatory sequences, including promoter sequences, terminator fragments, polyadenylation sequences, enhancer sequences, marker genes and other sequences as appropriate. Preferably, the vector contains appropriate regulatory sequences to drive the expression of the nucleic acid in a host cell.

Suitable regulatory sequences to drive the expression of heterologous nucleic acid coding sequences in expression systems are well-known in the art and include constitutive promoters, for example viral promoters such as CMV or SV40, and inducible promoters, such as Tet-on controlled promoters. A vector may also comprise sequences, such as origins of replication and selectable markers, which allow for its selection and replication and expression in bacterial hosts such as *E. coli* and/or in eukaryotic cells.

Many techniques and protocols that are suitable for the expression of recombinant chimeric proteins in cell culture and their subsequent isolation and purification are known in the art (see for example *Protocols in Molecular Biology*, Second Edition, Ausubel et al. eds. John Wiley & Sons, 1992; Recombinant Gene Expression Protocols Ed RS Tuan (March 1997) Humana Press Inc).

A host cell comprising a nucleic acid encoding a chimeric protein as described herein or vector containing such a nucleic acid is also provided as an aspect of the invention. Suitable host cells include bacteria, mammalian cells, plant cells, filamentous fungi, yeast and baculovirus systems and transgenic plants and animals. The expression of proteins in prokaryotic cells is well established in the art. A common bacterial host is *E. coli*. A chimeric protein may also be produced by expression in eukaryotic cells in culture. Mammalian cell lines available in the art for expression of a chimeric protein include Chinese hamster ovary (CHO) cells, HeLa cells, baby hamster kidney cells, NS0 mouse melanoma cells, YB2/0 rat myeloma cells, human embryonic kidney cells (e.g. HEK293 cells), human embryonic retina cells (e.g. PerC6 cells) and many others.

The following procedures and assays may be used according to the invention.

Preparation of Grafted Scaffold Protein

Large-Scale Protein Purification (His-Tagged) from *E. coli*

The pRSET B (His-tag) constructs are transformed into chemically competent *E. coli* C41 cells by heat shock and plated on LB-Amp plates. Colonies are grown in 2TY media containing ampicillin (50 micrograms/mL) at 37° C., 220 rpm until the optical density (O.D.) at 600 nm reached 0.6. Cultures are then induced with IPTG (0.5 mM) for 16-20 h at 20° C. or 4 h at 37° C. Cells are pelleted by centrifugation at 3000 g (4° C., 10 min) and resuspended in lysis buffer (10 mM sodium phosphate pH 7.4, 150 mM NaCl, 1 tablet of SIGMAFAST protease inhibitor cocktail (EDTA-free per 100 mL of solution), then lysed on a Emulsiflex C5 homogenizer at 15000 psi. Cell debris is pelleted by centrifugation at 15,000 g at 4° C. for 45 min. Ni-NTA beads 50% bed volume (GE Healthcare) (5 mL) are washed once with phosphate buffer (10 mM sodium phosphate pH 7.4, 150 mM NaCl) before the supernatant of the cell lysate is bound to them for 1 hr at 4° C. in batch. The loaded beads are washed three times with phosphate buffer (40 mL) containing 30 mM of imidazole to prevent non-specific interaction of lysate proteins with the beads. Samples are eluted using phosphate buffer with 300 mM imidazole, and purified by size-exclusion chromatography using a HiLoad 16/60 SuperdexG75 column (GE Life-Science) pre-equilibrated in phosphate buffer (10 mM sodium phosphate, pH 7.4, 150 mM NaCl) and proteins separated in isocratic conditions. Purity is checked on NuPage protein gel (Invitrogen), and fractions found to be over 95% pure are pooled. Purified protein is flash-frozen and stored at −80° C. until further use. Concentrations are determined by measuring absorbance at 280 nm and using a calculated extinction coefficient from ExPASy ProtParam (Gasteiger et al. 2005) for each variant. Molecular weight and purity is confirmed using mass spectrometry (MALDI).

Large-Scale Protein Purification (Heat Treatment) from *E. coli*

Many of the chimeric proteins described herein are thermally very stable, with melting temperatures above 80° C. This means that the chimeric proteins could be separated from *E. coli* proteins by incubating the cell lysates at 65° C. for 20 min. Very few of the *E. coli* proteins will remain folded at such temperatures, and therefore, they will unfold and aggregate. Aggregated proteins are removed by centrifugation, leaving 80-90% pure sample of the desired protein. Constructs that fold reversibly can be further purified by methods such as acetone or salt precipitation to remove DNA and other contaminants.

This approach allows the production of large amounts of functional proteins without expensive affinity purification methods such as antibodies or His tags and is potentially scalable to industrial production and bioreactors.

Small-Scale Purification of His-Tagged Proteins for Higher-Throughput Testing

Plasmids are transformed into *E. coli* C41 cells and plated overnight. 15 mls of 2TY medium (Roche) containing 50 micrograms/ml ampicillin is placed in each one f multiple 50 ml tubes. Several colonies are picked from the plates and resuspended in each 15 ml culture. For sufficient aeration it is important to only loosely tighten the lids of the 50 ml tubes. Cells are grown at 37° C. until OD600 of 0.6 and then induced with 0.5 mM IPTG overnight. Cells are pelleted at 3000 g (Eppendorf Centrifuge 5804) and then resuspended in 1 ml of BugBuster® cell lysis reagent. Alternatively, sonication in combination with lysozyme and DNAse I treatment is used. The lysate is spun at 12000 g for 1 minute to pellet any insoluble protein and cell debris.

The supernatant is added to 100 µl bed volume of prewashed Ni-NTA agarose beads. The subsequent affinity purification is performed in batch, by washing the beads 4 times with 1 10 ml of buffer each time (alternatively, Qiagen Ni-NTA Spin Columns can be used). The first ish contained 10% BugBuster® solution and 30 mM imidazole in the chosen buffer. Here we used 50 mM sodium phosphate buffer pH 6.8, 150 mM NaCl. The three successive ishes had 30 mM of imidazole in the chosen buffer. Beads are washed thoroughly to remove the detergent present in the BugBuster® solution. Protein is eluted from the beads in a single step using 1 ml of chosen buffer containing 300 mM imidazole. The combination of Bugbuster® and imidazole and the repeat washes in small bead volumes yielded >95% pure protein. Imidazole is removed using a NAP-5 disposable gel-filtration column (GE Healthcare).

Measuring Binding of Grafted Scaffold Protein to Target Protein

Competition Fluorescence Polarisation (FP) Assay

To measure the binding of a grafted scaffold to a target protein, Competition FP can be performed using 384-well black opaque optiplate microplates and a CLARIOstar microplate reader. The grafted scaffold protein is titrated into a solution containing a mixture of FITC-labelled peptide ligand and target binding partner (target protein). The prepared plates are incubated for 30 minutes at room temperature before readings are taken. The grafted scaffold is then titrated into the preformed FITC-peptide-target protein complex. A decrease in polarisation with increasing concentrations of grafted scaffold indicates displacement of FITC-peptide upon binding of the grafted scaffold to its target.

Isothermal Titration Calorimetry (ITC)

ITC can be performed using a VP-ITC instrument (Microcal). Grafted scaffolds are dialysed into 10 mM sodium phosphate buffer pH 7.4, 150 mM NaCl, 0.5 mM TCEP. Dialysed target protein (200 µM) is titrated into the sample cell containing the grafted scaffold at 20 µM. Injections of target protein into the cell are initiated with a 5 µL injection, followed by 29 injections of 10 µL. The reference power is set at 15 µCal/s with an initial delay of 1000 s and a stirring speed of 485 rpm. Data are fitted using the instrument software a one-site binding model.

Cell Culture and Cell Transfection

HEK293T cells are cultured in Dulbecco's Modified Eagle's Medium (Sigma Aldrich) supplemented with 10% fetal bovine serum and penicillin/streptomycin (LifeTech) at 37° C. with 5% $CO_2$ air supply.

HEK293T are seeded in 6-well tissue culture plates (500,000 cells per well) and transfected the next day using the Lipofectamine2000 transfection reagent (Invitrogen) according to the manufacturer's protocol.

Western Blot Assay of Target-Protein Engagement and of Target-Protein Levels

Plasmid encoding the target protein (1 µg) alone and with plasmid encoding one of various target-specific grafted scaffolds (1 µg) is transfected in HEK293T cells in 6-well plates using Lipofectamine2000. After 48 hours of transfection, the cells are lysed in 200 µL of Laemmli buffer. After sample is boiled at 95° C. for 20 min proteins are resolved by SDS-PAGE and transferred to a PVDF membrane, and immunoblotting is performed using anti-HA ($C_{29}F4$, Cell Signaling Technologies) and anti-actin (A2066, Sigma-Aldrich) antibodies. Changes in target protein levels upon co-transfection with bifunctional grafted scaffolds are evaluated by the densitometry of the bands corresponding to the target protein normalised to actin levels using ImageJ. Co-immunoprecipitation can also be used to show that the grafted scaffold binds to the target protein and/or to the desired component of the degradation machinery.

Liposomal Formulation and Cytotoxicity Assay

To make liposomal formulations of proteins (LFP), lipids (DOTAP (cationic): DOPE (neutral): DiR (aromatic)=1:1: 0.1 w/w) are dissolved in chloroform, and solvent is evaporated under vacuum overnight. Resulting mixed lipid cake is hydrated with 10 mM HEPES pH 7.4, containing 27 µM protein, so that the total lipid concentration is 4 mg/ml. This mixture is vortexed for 2 minutes and then sonicated for 20 minutes at room temperature. Liposomes encapsulating proteins are stored at 4° C. until further use. To make empty liposomes (EL, empty liposomes without proteins), lipid cake is hydrated with 10 mM HEPES pH 7.4 without proteins.

An ATP assay is used to investigate whether there is any cytotoxicity associated with EL and LFP. In a typical procedure, $2 \times 10^5$ HEK 293T cells/well in 500 µL of Dulbecco's Modified Eagles Medium (DMEM) supplemented with 10% fetal bovine serum are grown for 24 hours in a 24-well cell culture plate. Cells are incubated with liposome (EL/LFP)-media (DMEM without FBS) mix, having different volumes (0-60 µL) of EL and LFP, for 15 minutes at 37° C. After washing twice with 1×PBS, 500 µL of CellTiter-Glo® Reagent (Promega) is added and luminescence is measured using a microplate reader as par the manufacture's protocol. Untreated cells are used as control. Data are obtained from triplicate samples, and the standard deviations are calculated from two independent experiments.

HiBit split-luciferase assay

An alternative method for measuring target protein levels is the Nano-Glo® HiBiT Lytic Detection System from Promega Corporation. It is based on the split NanoLuc assay, which consists of a large N-terminal fragment (LgBiT) and a small C-terminal region (SmBiT). Five of the SmBiT amino acids have been replaced to produce the HiBiT (VSGWRLFKKIS) (SEQ ID NO: 3102) fragment, which has greater affinity for the LgBiT fragment and maintains NanoLuc luciferase activity. Either the HiBiT-tagged target DNA can be transient transfected or the endogenous target can be monitored by knock-in of the HiBiT tag sequence using CRISPR/Cas9 technology. Subsequent introduction of the complementary polypeptide, LgBiT, results in spontaneous and high affinity interaction between the HiBiT tag and LgBiT to reconstitute the luminescent NanoBit® enzyme. Detection of tagged protein levels is possible from live or lysed cells.

Protein is introduced into HEK293T cells by either DNA transient transfection or encapsulation within fusogenic liposomes. HEK293T cells are seeded into either 24-well or 96-well plates After 24 hours, DNA encoding the HiBiT-tagged target protein (20 ng for 96-well plate; 100 ng for 24-well plate) is transiently transfected into cells. Chimeric protein DNA (100 ng) is either transiently transfected into cells at the same time as HiBiT-target DNA transfection or encapsulated into liposomes and introduced 24 hours into the cells after transfection. Cells are treated with chimeric protein-containing liposomes for 15 minutes before 2 hours of incubation.

Nano-Glo® HiBiT Lytic Buffer (LgBiT protein (1:100), Nano-Glo® HiBiT Lytic Substrate (1:50) 1x PBS (1:1)) is added to the cells 24 hours after transient transfection or 2 hours after liposomal treatment. The plates are shaken on an orbital shaker (1,000 rpm, 10 min) to ensure homogenous cell lysis and equilibration of LgBiT and HiBiT in the cell lysate. The luminescence measurements are performed in white Nunclon™ Delta 96-well plates at 25° C. using a CLARIOstar plate reader using a 460-480 emission filter.

Determining Properties of a Grafted Scaffold

The biophysical properties of a grafted scaffold may be assessed as follows: The molar ellipticity at 222 nm (a measure of helical structure content) is monitored as a function of increasing temperature. A decrease in the molar ellipticity with increasing temperature indicates a loss of structure and the unfolding of the protein. This thermal unfolding experiment is used to determine the melting temperature of the scaffold and thereby to assess whether or not the grafting process has had a detrimental effect on the thermostability of the scaffold.

An alternative method to determine the thermodynamic stability of the proteins is to measure chemical-induced denaturation (either guanidine hydrochloride (GdnHCl) or urea) monitored by intrinsic protein fluorescence (tryptophan and tyrosine residues). Solutions are dispensed into Corning® 96-well, half-area, black polystyrene plates (CLS3993) with a Microlab ML510B dispenser (Hamilton) and measurements are carried out on a CLARIOstar Plate Reader (BMG Labtech). The buffer is added first into the wells, followed by 15 µl aliquots of protein stock. A stock solution of chemical denaturant (either 7 M GdnHCl or 9 M urea) is then dispensed into the wells to create a chemical-denaturant concentration gradient.

Preparation of a Helix-Grafted Scaffold that Binds to a Target Protein

First, the helix of a given protein that interacts with its target binding partner is mapped onto the heptad distribution, and the stapled side of the peptide is set so as to form the hydrophobic interface with the rest of the scaffold protein. The grafted scaffold may then be docked against the target protein using Haddock software (de Vries & Bonvin 2011; de Vries et al. 2010). Haddock is a data-driven docking algorithm that uses known information about the interaction for its calculations. The active (primary interaction residues) and the passive (5 Å proximity to active) residues are extracted and inputted into the calculations. Docking is not necessary to validate helical grafted scaffold, and inspection of the structure of the helix-target protein structure and of the scaffold structure may be sufficient: The geometry of alpha-helices permits selection of amino acid positions of the scaffold that accommodate outward facing target binding residues of the peptide ligand.

Preparation of a Grafted Scaffold with a Single Binding Function Grafted onto an Inter-Repeat Loop First, a peptide ligand that binds to a given target protein is grafted onto the scaffold in a loop. Binding of the loop-grafted scaffold may be tested using ITC. ITC is particularly useful to assess these interactions, as it can measure the stoichiometry (n) of the interaction, and thus inform as to which loops (if there is more than one loop) are more or less accessible to the target protein, and can inform as to whether a multi-loop scaffold affords multivalency. An advantage of a multivalent grafted scaffold is that one may achieve an avidity effect. This is particularly useful where a target molecule has multiple domains that can be bound by a peptide ligand. Binding of a multivalent grafted scaffold to such a target protein would produce an increased binding affinity and a decreased off rate according to the number of repeats in the grafted scaffold, thus achieving an avidity effect.

Introducing Multivalency into a Single Binding Function Scaffold

The function of a multi-valent grafted scaffold containing variable numbers of the peptide ligand binding motif that binds to a given target protein can be tested using the same assays as for the mono-valent grafted scaffold. The results are used to assess whether increased potency can be achieved by increasing the valency.

Preparing a Loop-Grafted Scaffold Using a Peptide Ligand that Binds to an E3 Ubiquitin Ligase A peptide ligand that is known to bind the substrate recognition subunit of an E3 ligase (see Table 3 for such peptides and ligases) is inserted into the scaffold loop. Immunoprecipitation is used to confirm binding of the grafted scaffold to the E3 ligase. ITC analysis is used to assess the affinity of the interaction.

Preparation of Hetero-Bifunctional Scaffolds that Direct Target Proteins for Ubiquitination and Subsequent Degradation A bispecific grafted scaffold is constructed using a peptide ligand specific for a target protein (see Table 2) and a peptide ligand specific for an E3 ligase.

To test whether these bispecific grafted scaffolds are capable of directing the target protein for ubiquitination and degradation, a plasmid encoding the hetero-bifunctional scaffold is transfected into HEK293T cells using Lipofectamine2000 together with HA-tagged β-catenin plasmid (using cells transfected with HA-tagged β-catenin plasmid alone as a control). After 48 hours of transfection, the cells are lysed, the sample is boiled and proteins are resolved by SDS-PAGE and immunoblotting is performed using anti-HA and anti-actin antibodies. Changes in target protein levels are evaluated by the densitometry of the bands corresponding to HA-target protein normalised to actin levels. In this way, different combinations of target protein binding peptides and E3 ligase peptide ligands can be compared for their abilities to reduce the levels of target protein.

Delivering a Grafted Scaffold Protein into Cells

A grafted scaffold protein is encapsulated within fusogenic liposomes made from cationic, neutral, and aromatic lipids, and then delivered into cells. Empty liposomes and liposomes encapsulating grafted scaffolds have been determined to be non-toxic to cells.

Libraries

Chimeric proteins as described herein may be used to produce libraries. For example, where a given chimeric protein (grafted scaffold) is demonstrated to binds bispecifically to a target protein and to an E3 ligase may be further optimized by changing amino acid residues of the grafted scaffold and selecting for stronger or weaker binders.

Chimeric proteins which are demonstrated to bind may be further engineered to improve an activity or property or introduce a new activity or property, for example a binding property such as affinity and/or specificity, an in vivo property such as solubility, plasma stability, or cell penetration, or an activity such as increased neutralization of the target molecule and/or modulation of a specific activity of the target molecule or an analytical property. Chimeric proteins may also be engineered to improve stability, solubility or expression level.

Alternatively, a library may be used to screen in order to identify and isolate chimeric proteins with specific binding activity.

A library may comprise chimeric proteins, each chimeric protein in the library comprising:
(i) two or more repeat domains,
(ii) inter-repeat loops linking the repeat domains; and
(iii) one or more peptide ligands, each the peptide ligand being located in an inter-repeat loop or at the N or C terminus of the chimeric protein,
wherein at least one amino acid residue in the peptide ligands in the library is diverse.

The residues at one or more positions in the peptide ligand of the chimeric proteins in the library may be diverse or randomised i.e. the residue located at the one or more positions may be different in different molecules in a population.

For example, 1 to 12 positions within a helical peptide ligand at the N or C terminus of the chimeric proteins in the library may be diverse or randomised. In addition, the non-constrained $X_n$ sequence of the peptide ligand may contain additional diversity. Alternatively or additionally, 1 to n positions within an inter-repeat peptide ligand of the chimeric proteins in the library may be diverse or randomised, where n is the number of amino acids in the peptide ligand.

In some embodiments, peptide ligands may be screened individually and a chimeric protein progressively assembled from repeat domains comprising peptide ligands identified in different rounds of screening. For example, a library may comprise chimeric proteins, each chimeric protein in the library comprising:
(i) two or more repeat domains,
(ii) inter-repeat loops linking the repeat domains; and
(iii) one or more constant peptide ligands having the same amino acid sequence in
each chimeric protein in the library and one or more diverse peptide ligands, preferably one diverse peptide ligand, having a different amino acid sequence in each chimeric protein in the library, the peptide ligands being located in an inter-repeat loop or at the N or C terminus of the chimeric protein.

At least one amino acid residue in the diverse peptide ligands in the library may be diverse.

A library may be produced by a method comprising:
(a) providing a population of nucleic acids encoding a diverse population of chimeric proteins comprising
(i) two or more repeat domains,
(ii) inter-repeat loops linking the two or more repeat domains; and
(iii) one or more peptide ligands, each the peptide ligand being located in an inter-repeat loop or at the N or C terminus of the chimeric protein,
wherein one or more residues of a peptide ligand in each chimeric protein is diverse in the library, and
(b) expressing the population of nucleic acids to produce the diverse population, thereby producing a library of chimeric proteins.

The population of nucleic acids may be provided by a method comprising inserting a first population of nucleic acids encoding a diverse peptide ligand into a second population of nucleic acids encoding the two or more repeat domains linked by inter-repeat loops, optionally wherein the first and second nucleic acids are linked with a third population of nucleic acids encoding linkers of up to 10 amino acids.

The nucleic acids may be contained in vectors, for example expression vectors. Suitable vectors include phage-based or phagemid-based phage display vectors.

The nucleic acids may be recombinantly expressed in a cell or in solution using a cell-free in vitro translation system such as a ribosome, to generate the library. In some preferred embodiments, the library is expressed in a system in which the function of the chimeric protein enables isolation of its encoding nucleic acid. For example, the chimeric protein may be displayed on a particle or molecular complex to enable selection and/or screening. In some embodiments, the library of chimeric proteins may be displayed on beads, cell-free ribosomes, bacteriophage, prokaryotic cells or eukaryotic cells. Alternatively, the encoded chimeric protein may be presented within an emulsion where activity of the chimeric protein causes an identifiable change. Alternatively, the encoded chimeric protein may be expressed within or in proximity of a cell where activity of the chimeric protein causes a phenotypic change or changes in the expression of a reporter gene.

Preferably, the nucleic acids are expressed in a prokaryotic cell, such as *E coli*. For example, the nucleic acids may be expressed in a prokaryotic cell to generate a library of recombine binding proteins that is displayed on the surface of bacteriophage. Suitable prokaryotic phage display systems are well known in the art, and are described for example in Kontermann, R & Dubel, S, *Antibody Engineering*, Springer-Verlag New York, LLC; 2001, ISBN: 3540413545, WO92/01047, U.S. Pat. Nos. 5,969,108, 5,565,332, 5,733,743, 5,858,657, 5,871,907, 5,872,215, 5,885,793, 5,962,255, 6,140,471, 6,172,197, 6,225,447, 6,291,650, 6,492,160 and 6,521,404. Phage display systems allow the production of large libraries, for example libraries with $10^8$ or more, 109 or more, or $10^{10}$ or more members.

In other embodiments, the cell may be a eukaryotic cell, such as a yeast, insect, plant or mammalian cell.

A diverse sequence as described herein is a sequence which varies between the members of a population i.e. the sequence is different in different members of the population. A diverse sequence may be random i.e. the identity of the amino acid or nucleotide at each position in the diverse sequence may be randomly selected from the complete set of naturally occurring amino acids or nucleotides or a sub-set thereof. Diversity may be introduced into the peptide ligand using approaches known to those skilled in the art, such as oligonucleotide-directed mutagenesis[22], *Molecular Cloning: a Laboratory Manual:* 3rd edition, Russell et al., 2001, Cold Spring Harbor Laboratory Press, and references therein).

Diverse sequences may be contiguous or may be distributed within the peptide ligand. Suitable methods for introducing diverse sequences into peptide ligand are well-described in the art and include oligonucleotide-directed mutagenesis (see *Molecular Cloning: a Laboratory Manual:* 3rd edition, Russell et al., 2001, Cold Spring Harbor Laboratory Press, and references therein). For example, diversification may be generated using oligonucleotide mixes created using partial or complete randomisation of nucleotides or created using codons mixtures, for example using tri-nucleotides. Alternatively, a population of diverse oligonucleotides may be synthesised using high throughput gene synthesis methods and combined to create a precisely defined and controlled population of peptide ligands. Alternatively, "doping" techniques in which the original nucleotide predominates with alternative nucleotide(s) present at lower frequency may be used.

Preferably, the library is a display library. The chimeric proteins in the library may be displayed on the surface of particles, or molecular complexes such as beads, for example, plastic or resin beads, ribosomes, cells or viruses, including replicable genetic packages, such as yeast, bacteria or bacteriophage (e.g. Fd, M13 or T7) particles, viruses, cells, including mammalian cells, or covalent, ribosomal or other in vitro display systems. Techniques for the production of display libraries, such as phage display libraries are well known in the art. Each particle or molecular complex may comprise nucleic acid that encodes the chimeric protein that is displayed by the particle.

In some preferred embodiments, the chimeric proteins in the library are displayed on the surface of a viral particle such as a bacteriophage. Each chimeric protein in the library may further comprise a phage coat protein to facilitate display. Each viral particle may comprise nucleic acid encoding the chimeric protein displayed on the particle. Suitable viral particles include bacteriophage, for example filamentous bacteriophage such as M13 and Fd.

Suitable methods for the generation and screening of phage display libraries are well known in the art. Phage display is described for example in WO92/01047 and U.S. Pat. Nos. 5,969,108, 5,565,332, 5,733,743, 5,858,657, 5,871,907, 5,872,215, 5,885,793, 5,962,255, 6,140,471, 6,172,197, 6,225,447, 6,291,650, 6,492,160 and U.S. Pat. No. 6,521,404.

Libraries as described herein may be screened for chimeric proteins which display binding activity, for example binding to a target molecule. Binding may be measured directly or may be measured indirectly through agonistic or antagonistic effects resulting from binding. A method of screening may comprise;
(a) providing a library of chimeric proteins, each chimeric protein in the library comprising;
    (i) two or more repeat domains,
    (ii) inter-repeat loops linking the repeat domains; and
    (iii) one or more peptide ligands, each the peptide ligand being located in an inter-repeat loop or at the N or C terminus of the chimeric protein,
    wherein one or more residues of the one or more peptide ligands are diverse in the library,
(b) screening the library for chimeric proteins which display a binding activity, and
(c) identifying one or more chimeric proteins in the library which display the binding activity.

In some embodiments, the chimeric proteins in the library may comprise one peptide ligand with at least one diverse amino acid residue. Conveniently the chimeric proteins in the library comprise two repeat domains. The library may be screened for peptide ligands that bind to a target molecule. Peptide ligands identified in this fashion can be assembled in a modular fashion to generate a chimeric protein as described herein that is multi-specific.

For example, a first library may be screened for a first peptide ligand that binds to a first target molecule and a second library may be screened for a second peptide ligand that binds to a second target molecule. The first and second peptide ligands are in different locations in the chimeric protein i.e. they are not both N terminal peptide ligands, C terminal peptide ligands or inter-repeat peptide ligands. First and second peptide ligands that bind to the first and second target molecules, respectively, are identified from the first and second libraries. The identified first and second peptide ligands may then be incorporated into a chimeric protein that binds to the first and second target molecules.

Figure 16:
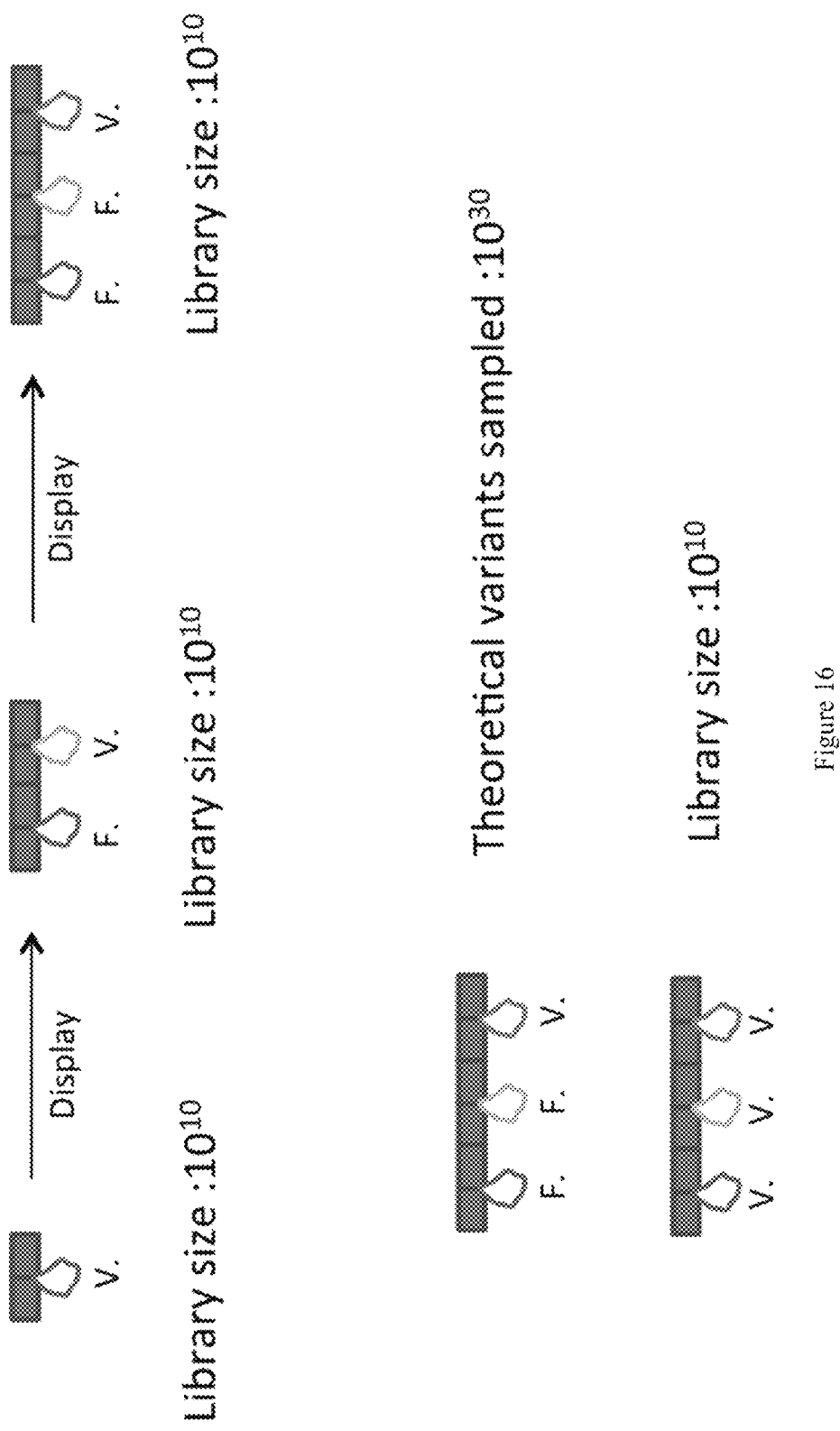
FIG. 16 shows a schematic of the assembly of a chimeric protein by the progressive screening of chimeric proteins comprising modules with a diverse peptide ligand in addition to modules already identified in previous rounds of screening.

A first library may comprise chimeric proteins in the library with a first diverse peptide ligand having at least one diverse amino acid residue. A first peptide ligand that binds to a target molecule may be identified from the first library. Chimeric proteins comprising the first peptide ligand may be used to generate a second library comprising a second diverse peptide ligand having at least one diverse amino acid residue. For example, the chimeric protein from the first library may be modified by addition of a second diverse peptide ligand at the N or C terminal or by the addition of additional repeat domains comprising the second diverse peptide ligand in an inter-repeat loop. A second peptide ligand that binds to the same or a different target molecule may be identified from the second library. Chimeric proteins comprising the first and second peptide ligands may be used to generate a third library comprising a third diverse peptide ligand having at least one diverse amino acid residue. For example, the chimeric protein from the second library may be modified by addition of a third diverse peptide ligand at the N or C terminal or by the addition of additional repeat domains comprising the third diverse peptide ligand in an inter-repeat loop. A third peptide ligand that binds to the same target molecule as the first and/or second peptide ligands or a different target molecule may be identified from the third library. In this way, a chimeric protein containing multiple peptide ligands may be sequentially assembled (see FIG. 16).

The use of separate libraries for each peptide ligand allows large numbers of different variants of each peptide ligand to be screened independently and then combined. For example, a phage library of $10^8$-$10^{12}$ first peptide ligand variants may be combined with a phage library of $10^8$-$10^2$ second peptide ligand variants and a phage library of $10^8$-$10^2$ third peptide ligand variants. In some embodiments, a phage library of $10^8$-$10^2$ N terminal peptide ligand variants may be combined with a phage library of $10^8$-$10^{12}$ C terminal peptide ligand variants to generate a chimeric protein with N and C terminal peptide ligands.

Screening a library for binding activity may comprise providing a target molecule and identifying or selecting members of the library that bind to the target, or expressing the library in a population of cells and identifying or selecting members of the library that elicit a cell phenotype.

The one or more identified or selected chimeric proteins may be recovered and subjected to further selection and/or screening.

In other embodiments, the chimeric proteins in the library may comprise a first peptide ligand for a first target molecule, which has at least one diverse amino acid residue, and a second peptide ligand for a second target molecule, which has at least one diverse amino acid residue. The library may be screened for peptide ligands that bind to the first and second target molecules. For example, the library may be screened for chimeric proteins comprising a first peptide ligand that binds to a first target molecule and a second peptide ligand that binds to a second target molecule.

Screening a library for binding activity may comprise providing a target molecule and identifying or selecting members of the library that bind to the target, or expressing the library in a population of cells and identifying or selecting members of the library that elicit a cell phenotype. The one or more identified or selected chimeric protein may be recovered and subjected to further selection and/or screening.

Chimeric proteins as described herein may be used to produce libraries comprising different combinations of peptide ligands grafted into a scaffold. The combinations of ligands may comprise first peptide ligands that bind to a members of a protein degradation pathway, such as an E3 ubiquitin ligase, and second peptide ligands that bind to a target molecule. A library may be screened in order to identify and isolate chimeric proteins which display an activity selected from (i) binding to the member of a protein degradation pathway and the target molecule, (ii) causing degradation of the target molecule in a cell through the protein degradation pathway.

A library may comprise chimeric proteins, each chimeric protein in the library comprising:
(i) a scaffold;
(ii) a first peptide ligand for a member of a protein degradation pathway and
(iii) a second peptide ligand for a target molecule, the peptide ligands being located at and of the scaffold of the chimeric domain,
wherein different chimeric proteins in the library comprise different first peptide ligands for different members of the protein degradation pathway and different second peptide ligands for the target molecule, the chimeric proteins in the library comprising different combinations of the first and second peptide ligands.

Suitable chimeric proteins, target molecules and members of protein degradation pathways and examples of peptide ligands thereto are described elsewhere herein.

Preferably, the member of a protein degradation pathway is an E3 ubiquitin ligase. For example, each chimeric protein in a library of chimeric proteins may comprise:
(i) a scaffold;
(ii) a first peptide ligand for an E3 ubiquitin ligase and
(iii) a second peptide ligand for a target molecule, the peptide ligands being located at and of the scaffold of the chimeric domain,
wherein the chimeric proteins in the library comprise first peptide ligands for different E3 ubiquitin ligases and different second peptide ligands for the target molecule, the chimeric proteins comprising different combinations of the first and second peptide ligands.

Different chimeric proteins in the library may comprise a peptide ligand for a different E3 ubiquitin ligase. For example, the chimeric proteins in the library may comprise peptide ligands for a panel of E3 ubiquitin ligases, each chimeric protein in the library comprising a peptide ligand for one of the E3 ubiquitin ligases in the panel.

Numerous E3 ubiquitin ligases are known in the art. A suitable panel of E3 ubiquitin ligases may for example, comprise two, three, four, five or more of Mdm2, SCF (Skp2), Cul3-Keap1, Cul3-SPOP, APC/C, SIAH, $SCF^{Flow7}$, $SCF^{Flow8}$, Cul4-DDB1-Cdt2, DDB1-Cul4, DDB1-Cul5, SOCS box-Cul5-SPSB2, SOCS box-Cul5-SPSB4, CHIP, CRL4(COP1/DET), UBR5, CRL2(KLHDC2), GID4, TRIM21, Nedd4, Elongin C and β-TRP. Examples of peptide ligands for E3 ubiquitin ligases are shown in Table 3.

The target molecule may be a target molecule as described above, for example, β-catenin, KRAS, or myc. The chimeric proteins in the library may comprise different peptide ligands for the target molecule i.e. different chimeric proteins in the library may comprise different peptide ligands for the same target molecule. Each chimeric protein in the library may comprise a different peptide ligand for the target molecule. Examples of peptide ligands target molecules are shown in Table 3. For example, the target molecule may be β-catenin, KRAS, or myc and the chimeric proteins in the library may comprise different peptide ligands for β-catenin, KRAS, or myc, respectively. Examples of different peptide ligands for β-catenin, KRAS, and myc are shown in Table 3.

A method of screening a library of chimeric proteins may comprise;
(a) providing a library of chimeric proteins, each chimeric protein in the library comprising:
(i) a scaffold;
(ii) a first peptide ligand for a member of a protein degradation pathway and
(iii) a second peptide ligand for a target molecule, the peptide ligands being located at and of the scaffold of the chimeric domain,
wherein the chimeric proteins in the library comprise first peptide ligands for different members of a protein degradation pathway and different second peptide ligands for the target molecule, the chimeric proteins comprising different combinations of the first and second peptide ligands,
(b) screening the library for chimeric proteins which display an activity selected from (i) binding to the member of a protein degradation pathway and the target molecule and (ii) causing degradation of the target molecule in a cell through the protein degradation pathway,
(c) identifying one or more chimeric proteins in the library which display the activity.

In some embodiments, the member of a protein degradation pathway may be an E3 ubiquitin ligase. A method of screening a library of chimeric proteins may comprise;
(a) providing a library of chimeric proteins, each chimeric protein in the library comprising:
(i) a scaffold;
(ii) a first peptide ligand for an E3 ubiquitin ligase and
(iii) a second peptide ligand for a target molecule, the peptide ligands being located at and of the scaffold of the chimeric domain,
wherein the chimeric proteins in the library comprise first peptide ligands for different E3 ubiquitin ligases and different second peptide ligands for the target molecule, the chimeric proteins comprising different combinations of the first and second peptide ligands,
(b) screening the library for chimeric proteins which display an activity selected from (i) binding to an E3 ubiquitin ligase and the target molecule, (ii) causing ubiquitination of the target molecule by an E3 ubiquitin ligase in a cell and (iii) causing degradation of the target molecule in a cell, (c) identifying one or more chimeric proteins in the library which display the activity.

A method may further comprise identifying one or more combinations of first and second peptide ligands in chimeric proteins in the library which display the activity.

Determination of Binding of a Chimeric Protein

Binding of a chimeric protein may be determined by any suitable technique, described below and in the examples herein.

Suitable methods for determining binding of a chimeric protein to a target molecule are well known in the art and include ELISA, bead-based binding assays (e.g. using streptavidin-coated beads in conjunction with biotinylated target molecules, surface plasmon resonance, flow cytometry, Western blotting, immunocytochemistry, immunoprecipitation, and affinity chromatography. Alternatively, biochemical or cell-based assays, such as fluorescence-based or luminescence-based reporter assays may be employed. For example, Isothermal Titration Calorimetry, Cell transfection followed by assaying for expressed chimeric protein, Liposomal formulation and cytotoxicity assays, a dual-Luciferase Reporter Assay System such as TOPFLASH®, and a competition fluorescence polarisation (FP) assay to measure the binding of a chimeric protein to its targets.

In some embodiments, binding may be determined by detecting agonism or antagonism resulting from the binding of a chimeric protein to a target molecule, such as a ligand, receptor or enzyme.

Where a library is in use, the library may be contacted with the target molecule under binding conditions for a time period sufficient for the target molecule to interact with the library and form a binding reaction complex with a least one member thereof. Binding conditions are those conditions compatible with the known natural binding function of the target molecule. Those compatible conditions are buffer, pH and temperature conditions that maintain the biological activity of the target molecule, thereby maintaining the ability of the molecule to participate in its preselected binding interaction. Typically, those conditions include an aqueous, physiologic solution of pH and ionic strength normally associated with the target molecule of interest. The library may be contacted with the target molecule in the form of a heterogeneous or homogeneous admixture. Thus, the members of the library can be in the solid phase with the target molecule present in the liquid phase. Alternatively, the target molecule can be in the solid phase with the members of the library present in the liquid phase. Still further, both the library members and the target molecule can be in the liquid phase.

Multiple rounds of panning may be performed in order to identify chimeric proteins which display the binding activity. For example, a population of chimeric proteins enriched for the binding activity may be recovered or isolated from the library and subjected to one or more further rounds of screening for the binding activity to produce one or further enriched populations. Chimeric proteins which display binding activity may be identified from the one or more further enriched populations and recovered, isolated and/or further investigated.

In some embodiments, binding may be determined by detecting agonism or antagonism resulting from the binding of a chimeric protein to a target molecule, such as a ligand, receptor or enzyme. For example, the library may be screened by expressing the library in reporter cells and identifying one or more reporter cells with altered gene expression or phenotype. Suitable functional screening techniques for screening recombinant populations of chimeric proteins are well-known in the art.

Further rounds of screening may be employed to identify chimeric proteins which display the improved property or activity. For example, a population of chimeric proteins enriched for binding to the target molecule may be recovered or isolated from the library and subjected to one or more further rounds of screening for the improved or new property or activity to produce one or further enriched populations. Optionally, this may be repeated one or more times. Chimeric proteins which display the improved property or activity may be identified from the one or more further enriched populations and recovered, isolated and/or further investigated.

A chimeric protein as described herein may be encapsulated in a liposome, for example for delivery into a cell. Preferred liposomes include fusogenic liposomes. Suitable fusogenic liposomes may comprise a cationic lipid, such as 1,2-dioleoyl-3-trimethylammoniumpropane (DOTAP), and a neutral lipid, such as dioleoylphosphatidylethanolamine (DOPE) for example in a 1:1 (w/w) ratio. Optionally, a liposome may further comprise an aromatic lipid, such as DiO (3, 3'-dioctadecyloxacarbocyanine perchlorate), DiR (1, 1'-dioctadecyl-3, 3, 3', 3'-tetramethylindotricarbocyanine iodide), N-(4,4-difluoro-5,7-dimethyl-4-bora-3a,4a-diazasindacene-3-propionyl)-1,2-dihexadecanoyl-sn-glycero-3-phosphoethanolamine (triethylammonium salt) (BODIPY FL-DHPE), and 2-(4,4-difluoro-5-methyl-4-bora-3a,4a-diazas-indacene-3-dodecanoyl)-1-hexadecanoyl-sn-glycero-3-phosphocholine (BODIPY-C12HPC) for example in a 0.1:1:1 (w/w) ratio relative to the neutral and cationic lipid. Suitable techniques for the encapsulation of proteins in liposomes and their delivery into cells are established in the art (see for example, Kube et al Langmuir (2017) 33 1051-1059; Kolasinac et al (2018) Int. J. Mol. Sci. 19 346).

A method described herein may comprise admixing a chimeric protein or encoding nucleic acid as described herein with a solution of lipids, for example in an organic solvent, such as chloroform, and evaporating the solvent to produce liposomes encapsulating the chimeric protein. Liposome encapsulations comprising a chimeric protein as described herein are provided as an aspect of the invention.

A chimeric protein or encoding nucleic acid as described herein may be admixed with a pharmaceutically acceptable excipient. A pharmaceutical composition comprising a chimeric protein or nucleic acid as described herein and a pharmaceutically acceptable excipient is provided as an aspect of the invention.

The term "pharmaceutically acceptable" as used herein pertains to compounds, materials, compositions, and/or dosage forms which are, within the scope of sound medical judgement, suitable for use in contact with the tissues of a subject (e.g., human) without excessive toxicity, irritation, allergic response, or other problem or complication, commensurate with a reasonable benefit/risk ratio. Each carrier, excipient, etc. must also be "acceptable" in the sense of being compatible with the other ingredients of the formulation. Suitable carriers, excipients, etc. can be found in standard pharmaceutical texts, for example, Remington's Pharmaceutical Sciences, 18th edition, Mack Publishing Company, Easton, Pa., 1990.

Pharmaceutical Compositions and Formulations

The pharmaceutical composition may conveniently be presented in unit dosage form and may be prepared by any methods well-known in the art of pharmacy. Such methods include the step of bringing the chimeric protein into association with a carrier which may constitute one or more accessory ingredients. In general, pharmaceutical compositions are prepared by uniformly and intimately bringing into association the active compound with liquid carriers or finely divided solid carriers or both, and then if necessary shaping the product.

Pharmaceutical compositions may be in the form of liquids, solutions, suspensions, emulsions, elixirs, syrups, tablets, lozenges, granules, powders, capsules, cachets, pills, ampoules, suppositories, pessaries, ointments, gels, pastes, creams, sprays, mists, foams, lotions, oils, boluses, electuaries, or aerosols.

Dosage and Mode of Administration

A chimeric protein, encoding nucleic acid or pharmaceutical composition comprising the chimeric protein or encoding nucleic acid may be administered to a subject by any convenient route of administration, whether systemically/peripherally or at the site of desired action, including but not limited to, oral (e.g. by ingestion); topical (including e.g. transdermal, intranasal, ocular, buccal, and sublingual); pulmonary (e.g. by inhalation or insufflation therapy using, e.g. an aerosol, e.g. through mouth or nose); rectal; vaginal; parenteral, for example, by injection, including subcutaneous, intradermal, intramuscular, intravenous, intraarterial, intracardiac, intrathecal, intraspinal, intracapsular, subcapsular, intraorbital, intraperitoneal, intratracheal, subcuticular, intraarticular, subarachnoid, and intrasternal; by implant of a depot, for example, subcutaneously or intramuscularly.

Pharmaceutical compositions suitable for oral administration (e.g., by ingestion) may be presented as discrete units such as capsules, cachets or tablets, each containing a predetermined amount of the active compound; as a powder or granules; as a solution or suspension in an aqueous or non-aqueous liquid; or as an oil-in-water liquid emulsion or a water-in-oil liquid emulsion; as a bolus; as an electuary; or as a paste.

Pharmaceutical compositions suitable for parenteral administration (e.g. by injection, including cutaneous, subcutaneous, intramuscular, intravenous and intradermal), include aqueous and non-aqueous isotonic, pyrogen-free, sterile injection solutions which may contain anti-oxidants, buffers, preservatives, stabilisers, bacteriostats, and solutes which render the formulation isotonic with the blood of the intended recipient; and aqueous and non-aqueous sterile suspensions which may include suspending agents and thickening agents, and liposomes or other microparticulate systems which are designed to target the compound to cells, tissue or organs. Examples of suitable isotonic vehicles for use in such formulations include Sodium Chloride Injection, Ringer's Solution, or Lactated Ringer's Injection. Typically, the concentration of the active compound in the solution is from about 1 ng/ml to about 10 µg/ml, for example, from about 10 ng/ml to about 1 µg/ml. The formulations may be presented in unit-dose or multi-dose sealed containers, for example, ampoules and vials, and may be stored in a freeze-dried (lyophilised) condition requiring only the addition of the sterile liquid carrier, for example water for injections, immediately prior to use.

It will be appreciated that appropriate dosages of the chimeric protein, can vary from patient to patient. Determining the optimal dosage will generally involve the balancing of the level of diagnostic benefit against any risk or deleterious side effects of the administration. The selected dosage level will depend on a variety of factors including, but not limited to, the route of administration, the time of administration, the rate of excretion of the imaging agent, the amount of contrast required, other drugs, compounds, and/or materials used in combination, and the age, sex, weight, condition, general health, and prior medical history of the patient. The amount of imaging agent and route of administration will ultimately be at the discretion of the physician, although generally the dosage will be to achieve concentrations of the imaging agent at a site, such as a tumour, a tissue of interest or the whole body, which allow for imaging without causing substantial harmful or deleterious side-effects.

Administration in vivo can be effected in one dose, continuously or intermittently (e.g., in divided doses at appropriate intervals). Methods of determining the most effective means and dosage of administration are well known to those of skill in the art and will vary with the formulation used for therapy, the purpose of the therapy, the target cell being treated, and the subject being treated. Single or multiple administrations can be carried out with the dose level and pattern being selected by the physician.

Chimeric proteins described herein may be used in methods of diagnosis or treatment in human or animal subjects, e.g. human. Chimeric proteins for a target molecule may be used to treat disorders associated with the target molecule.

Other aspects and embodiments of the invention provide the aspects and embodiments described above with the term "comprising" replaced by the term "consisting of" and the aspects and embodiments described above with the term "comprising" replaced by the term "consisting essentially of".

It is to be understood that the application discloses all combinations of any of the above aspects and embodiments described above with each other, unless the context demands otherwise. Similarly, the application discloses all combinations of the preferred and/or optional features either singly or together with any of the other aspects, unless the context demands otherwise.

Modifications of the above embodiments, further embodiments and modifications thereof will be apparent to the skilled person on reading this disclosure, and as such, these are within the scope of the present invention.

All documents and sequence database entries mentioned in this specification are incorporated herein by reference in their entirety for all purposes.

"and/or" where used herein is to be taken as specific disclosure of each of the two specified features or components with or without the other. For example "A and/or B" is to be taken as specific disclosure of each of (i) A, (ii) B and (iii) A and B, just as if each is set out individually herein.

Certain aspects and embodiments of the invention will now be illustrated by way of example and with reference to the figures described above.

Experiments

1. Methods 1.1 Large-Scale Protein Purification (His-Tagged) from *E. coli*

The pRSET B (His-tag) constructs were transformed into chemically competent *E. coli* C41 cells by heat shock and plated on LB-Amp plates. Colonies were grown in 2TY media containing ampicillin (50 micrograms/mL) at 37° C., 220 rpm until the optical density (O.D.) at 600 nm reached 0.6. Cultures were then induced with IPTG (0.5 mM) for 16-20 h at 20° C. or 4 h at 37° C. Cells were pelleted by centrifugation at 3000 g (4° C., 10 min) and resuspended in lysis buffer (10 mM sodium phosphate pH 7.4, 150 mM NaCl, 1 tablet of SIGMAFAST protease inhibitor cocktail (EDTA-free per 100 mL of solution), then lysed on a Emulsiflex C5 homogenizer at 15000 psi. Cell debris was pelleted by centrifugation at 15,000 g at 4° C. for 45 min. Ni-NTA beads 50% bed volume (GE Healthcare) (5 mL)

were washed once with phosphate buffer (10 mM sodium phosphate pH 7.4, 150 mM NaCl) before the supernatant of the cell lysate was bound to them for 1 hr at 4° C. in batch. The loaded beads were washed three times with phosphate buffer (40 mL) containing 30 mM of imidazole to prevent non-specific interaction of lysate proteins with the beads. Samples were eluted using phosphate buffer with 300 mM imidazole, and purified by size-exclusion chromatography using a HiLoad 16/60 SuperdexG75 column (GE Life-Science) pre-equilibrated in phosphate buffer (10 mM sodium phosphate, pH 7.4, 150 mM NaCl) and proteins separated in isocratic conditions. Purity was checked on NuPage protein gel (Invitrogen), and fractions found to be over 95% pure were pooled. Purified protein was flash-frozen and stored at −80° C. until further use. Concentrations were determined by measuring absorbance at 280 nm and using a calculated extinction coefficient from ExPASy ProtParam (Gasteiger et al. 2005) for each variant. Molecular weight and purity was confirmed using mass spectrometry (MALDI.

1.2 Large-Scale Protein Purification (Heat Treatment) from E. coli

All chimeric proteins described herein are thermally very stable, with melting temperatures above 80° C. This means that the chimeric proteins could be separated from E. coli proteins by incubating the cell lysates at 65° C. for 20 min. Very few of the E. coli proteins survive such temperatures, and therefore, they will unfold and aggregate. Aggregated proteins were removed by centrifugation, leaving 80-90% pure sample of the desired protein. All our constructs folded reversibly, and therefore could be further purified by methods such as acetone or salt precipitation to remove DNA and other contaminants.

This approach allowed the production of large amounts of functional proteins without expensive affinity purification methods such as antibodies or His tags and is scalable to industrial production and bioreactors.

1.3 Small-Scale Purification of His-Tagged Proteins for Higher-Throughput Testing Plasmids were transformed into E. coli C41 cells and plated overnight. 15 mls of 2TY medium (Roche) containing 50 micrograms/ml ampicillin was placed in multiple 50 ml tubes. Several colonies were picked and resuspended in each 15 ml culture. For sufficient aeration it is important to only loosely tighten the lids of the 50 ml tubes. Cells were grown at 37° C. until OD600 of 0.6 and then induced with 0.5 mM IPTG overnight. Cells were pelleted at 3000 g (Eppendorf Centrifuge 5804) and then resuspended in 1 ml of Bug-Buster® cell lysis reagent. Alternatively, sonication in combination with lysozyme and DNAse I treatment was used. The lysate was spun at 12000 g for 1 minute to pellet any insoluble protein and cell debris.

The supernatant was added to 100 μl bed volume of pre-washed Ni-NTA agarose beads. The subsequent affinity purification was performed in batch, by washing the beads 4 times with 1 ml of buffer each time (alternatively, Qiagen Ni-NTA Spin Columns can be used). The first wash contained 10% BugBuster® solution and 30 mM imidazole in the chosen buffer. Here we used 50 mM sodium phosphate buffer pH 6.8, 150 mM NaCl. The three successive washes had 30 mM of imidazole in the chosen buffer. Beads were washed thoroughly to remove the detergent present in the BugBuster® solution. Protein was eluted from the beads in a single step using 1 ml of chosen buffer containing 300 mM imidazole. The combination of Bugbuster® and imidazole and the repeat washes in small bead volumes yielded >95% pure protein. Imidazole was removed using a NAP-5 disposable gel-filtration column (GE Healthcare).

1.4 Competition Fluorescence Polarization (FP)

To assay the binding of the designed SOS-TPR protein to KRAS, Competition FP was performed using purified KRAS Q61H mutant and (2'-(or-3')-O-(N-Methylanthraniloyl) Guanosine 5'-Triphosphate, a fluorescent version of GTP, also known as mant-GTP. SOS-TPR was titrated using a 2-fold serial dilution against a 1:1 complex of KRAS Q61H and mant-GTP (1 μM) in a black 96-well plate (CLS3993 SIGMA). Plates were prepared under reduced light conditions and incubated at room temperature. Readings were taken on the CLARIOstar microplate reader, using an excitation filter at 360 nm and emission filter at 440 nm.

1.5 Isothermal Titration Calorimetry (ITC)

ITC was performed at 25° C. using a VP-ITC (Microcal). 1TBP-CTPR2, 2TBP-CTPR4, 3TBP-CTPR6 and TNKS2 ARC4 were dialysed into 10 mM sodium phosphate buffer pH 7.4, 150 mM NaCl, 0.5 mM TCEP. Dialysed TNKS2 ARC4 (200 μM) was titrated into the sample cell containing 1TBP-CTPR2 at 20 μM. Similar experiments were performed for 2TBP-CTPR4 and 3TBP-CTPR6. Injections of TNKS2 ARC4 into the cell were initiated with a 5 μL injection, followed by 29 injections of 10 μL. The reference power was set at 15 μCal/s with an initial delay of 1000 s and a stirring speed of 485 rpm. Data were fitted using the instrument software a one-site binding model.

1.6 Cell Culture

HEK293T cells were cultured in Dulbecco's Modified Eagle's Medium (Sigma Aldrich) supplemented with 10% fetal bovine serum and penicillin/streptomycin (LifeTech) at 37° C. with 5% $CO_2$ air supply.

1.7 Cell Transfection

HEK293T were seeded in 6-well tissue culture plates (500,000 cells per well) and transfected the next day using the Lipofectamine2000 transfection reagent (Invitrogen) according to the manufacturer's protocol.

1.8 β-catenin levels western blot assay

HA-β-catenin (1 μg) alone and with various PROTACs (1 μg) was transfected in HEK293T cells in 6-well plates using Lipofectamine2000. After 48 hours of transfection, the cells were lysed in 200 μL of Laemmli buffer. After sample was boiled at 95° C. for 20 min proteins were resolved by SDS-PAGE and transferred to a PVDF membrane, and immunoblotting was performed using anti-HA (C29F4, Cell Signaling Technologies) and anti-actin (A2066, Sigma-Aldrich) antibodies. Changes in β-catenin levels were evaluated by the densitometry of the bands corresponding to HA-β-catenin normalised to actin levels using ImageJ.

1.9 Liposomal Formulation and Cytotoxicity Assay

To make liposomal formulations of proteins (LFP), lipids (DOTAP (cationic): DOPE (neutral): DiR (aromatic) 1:1:0.1 w/w) were dissolved in chloroform, and solvent was evaporated under vacuum overnight. Resulting mixed lipid cake was hydrated with 10 mM HEPES pH 7.4, containing 27 μM protein, so that the total lipid concentration is 4 mg/ml. This mixture was vortexed for 2 minutes and then sonicated for 20 minutes at room temperature. Liposomes encapsulating proteins were stored at 4° C. until further use. To make empty liposomes (EL, empty liposomes without proteins), lipid cake was hydrated with 10 mM HEPES pH 7.4 without proteins.

An ATP assay was used to investigate whether there is any cytotoxicity associated with EL and LFP. In a typical procedure, $2 \times 10^1$ HEK 293T cells/well in 500 μL of Dulbecco's Modified Eagles Medium (DMEM) supplemented with 10% fetal bovine serum were grown for 24 hours in a 24-well cell culture plate. Cells were incubated with liposome (EL/LFP)-media (DMEM without FBS) mix, having different volumes (0-60 µL) of EL and LFP, for 15 minutes at 37° C. After washing twice with 1×PBS, 500 µL of CellTiter-Glo® Reagent (Promega) was added and luminescence was measured using a microplate reader as par the manufacture's protocol. Untreated cells were used as control. Data were obtained from triplicate samples, and the standard deviations were calculated from two independent experiments.

1.10 TOPFLASH Assay

The Wnt pathway was activated by treating HEK293T cells with Wnt-conditioned media obtained from L-cells expressing Wnt3A for 8 days. To perform the assay, $10^5$ HEK293T cells/well were seeded on a 24-well plate Nunclon Delta Surface plate (NUNC) and incubated overnight at 37° C., 5% $CO_2$. The following day, cells were transfected with 100 ng of TOPflash TCF7L2-firefly luciferase plasmid, 10 ng of CMV-Renilla plasmid (as internal control) and 100 ng of the corresponding TPR construct. Plasmids were mixed with 0.5 µL of Lipofectamine 2000 transfection reagent according to the manufacturer's protocol (invitrogen). Transfected cells were allowed to recover for 8 h, then they were treated with Wnt-conditioned media (1:2 final concentration) for a further 16 h. The TOPflash assay was performed using the Dual-Luciferase Reporter Assay System (Promega) (Korinek et al., 1997 Science 275(5307): 1784-7) following the manufacturer's instructions. The activities of firefly and Renilla luciferases were measured sequentially from a single sample, using the CLARIOstar plate reader. Relative luciferase values were obtained from triplicate samples dividing the firefly luminescence activity by the CMV-induced Renilla activity, and standard deviation was calculated.

1.11 TOPFLASH Assay Using Liposome Encapsulation to Deliver Designed TPR Proteins into the Cell $10^5$ HEK 293T cells in 500 µL of Dulbecco's Modified Eagles Medium (DMEM) supplemented with 10% fetal bovine serum were grown overnight in each well of a 24-well cell culture plate. For TOPFLASH reporter assays, 100 ng/well of TOPFLASH plasmid and ng/well of CMV-Renilla plasmid (as internal control) were used to transfect cells in 24-well plates. Cells were transfected with the Lipofectamine 2000 transfection reagent according to the manufacturer's protocol (Invitrogen). Transfected cells were allowed to recover for 8 hours, and Wnt signalling was activated by addition of Wnt3A-conditioned media obtained from L-cells. 16 hours post Wnt pathway activation, proteins were delivered into the cells by liposomal treatment. Cells were incubated with liposome (LFP)-media (DMEM without FBS) mix for 15 minutes at 37° C. followed by one PBS wash. Wnt3A conditioned media was replaced and cells were incubated for variable time durations (2-8 hours). Following incubation, TOPFLASH assays were performed using the Dual-Luciferase Reporter Assay System (Promega) (Korinek et al., 1997) following the manufacturer's instructions. Relative luciferase values were obtained from triplicate samples (from two independent experiments) by dividing the firefly luciferase values (from TOPFLASH) by the Renilla luciferase values (from CMV renilla), and standard deviations were calculated.

1.12. Competition Fluorescence Polarisation (FP) Assay to Measure the Binding of Designed Nrf-TPR Proteins to Keap1

To measure the binding of the designed Nrf-TPR proteins to Keap1, Competition FP was performed using 384-well black opaque optiplate microplates and a CLARIOstar microplate reader. Nrf-TPR proteins were titrated into a solution containing a mixture of FITC-labelled Nrf2 peptide and Keap1 protein. The prepared plates were incubated for 30 minutes at room temperature before readings were taken.

2. Results

Tetratricopeptide repeat (TPR) is a 34-residue motif that can be repeated in tandem to generate modular proteins. TPRs are used here as an example of helix-turn-helix tandem-repeats arrays, but any tandem repeat array may be used.

RTPR proteins comprising TPRs were derived from the consensus TPR sequence (CTPR). Two repeats were found to be sufficient to generate a highly stable mini-protein of 68 amino acids (RTPR2). The biophysical properties of two types of engineering strategy; loop insertions and terminal helix grafting, were assessed. The molar ellipticity at 222 nm (a measure of helical secondary structure content) of three different RTPR modules was monitored as a function of increasing temperature. A decrease in the absolute molar ellipticity with increasing temperature indicates a loss of structure and the unfolding of the protein. Even at the highest temperature recorded (85° C.), the RTPR2 protein without insertion was not fully denatured (FIG. 1). RTPR2 with a 20-residue unstructured loop between the two repeats showed a small shift to a lower melting temperature (FIG. 1), but the protein remains fully folded up to 55° C. This is well above physiologically relevant temperatures. RTPR2 with an additional N-terminal helix showed an increase in absolute molar ellipticity, indicating that the additional helical domain is folded. Moreover, unlike the loop insertion, the helix domain was capable of stabilising the RTPR2 module, shifting the transition midpoint to above 90° C. (FIG. 1). These results showed that the two engineering strategies generated folded and stable modular mini-proteins capable of withstanding high temperatures.

Figure 2:
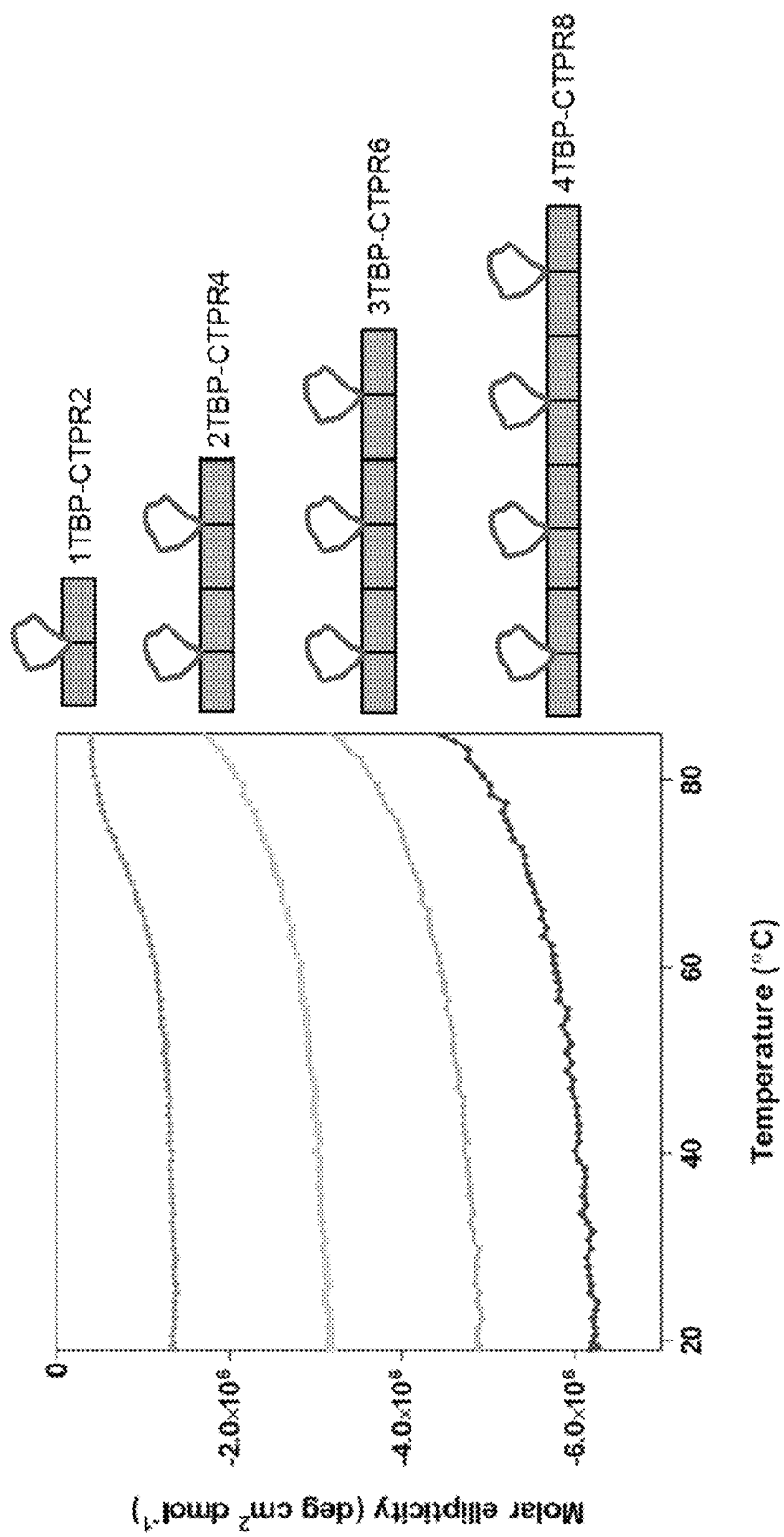
FIG. 2 shows the thermostability of CTPR proteins of increasing length containing an increasing number of binding modules (alternating with blank modules): Thermal denaturation curves, monitored by circular dichroism, of TPR proteins containing 1, 2, 3 and 4 loops comprising a tankyrase-binding sequence: 1TBP-CTPR2, 2TBP-CTPR4, 3TBP-CTPR6, 4TBP-CTPR8. All samples are at 20 µM in 10 mM sodium phosphate buffer pH 7.4, 150 mM NaCl.

A key feature of the TPR scaffold was its modular nature. This modularity allowed display any number of binding modules in tandem to obtain bi- and multi-valent and multi-functional molecules against one, two or more targets. The stability of these proteins was shown to be modular. The stabilities of proteins comprising TBP-CTPR2 (a two-repeat CTPR with a loop insertion that binds to the protein tankyrase (Guettler et al. 2011)) repeated in tandem were measured. The TBP-CTPR2-containing proteins had two, four, six, and eight repeats, and they displayed one, two, three and four binding loops, respectively. The helical content of the proteins, monitored by molar ellipticity at 222 nm, was found to increase in proportion to the number of repeats, as did the stability, indicating that they were behaving like classic helical repeat proteins (FIG. 2). These results demonstrate that bi- or multi-functional chimeric proteins have a high thermostability.

Figure 3A:
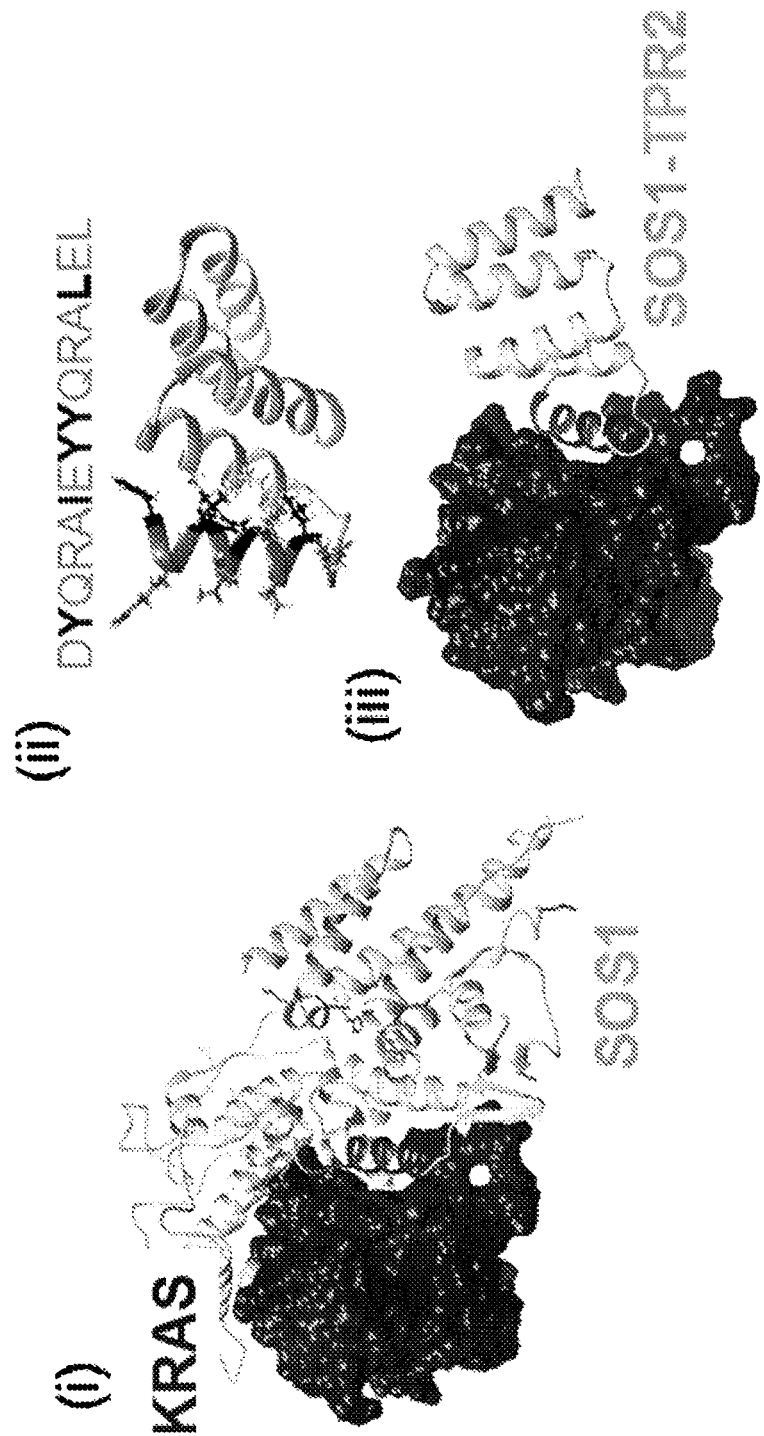
FIG. 3A (i) shows the crystal structures of SOS1 (son-of-sevenless homologue 1) bound to KRAS (Kirsten rat sarcoma) (PDB 1NVU, Margarit et al. Cell (2003) 112(5):685-95), and (ii) shows the SOS1 helix grafted onto a helix at the N-terminus of a CTPR2 protein (SEQ ID NO: 3098). The modelled structure of SOS-RTPR2 is shown, and the sequence of the helix is given with the key KRAS-binding residues in grey and the residues that form the interface with the CTPR helices in black. (iii) shows the modelled structure of SOS-TPR2 in complex with KRAS.

2.1. Demonstration of Proteins with a Single Binding Function Grafted onto an Alpha-Helix 2.1.1 SOS1-TPR. A Helix-Grafted Binding Module Designed to Bind to Oncoprotein KRAS First, we mapped the helix of SOS1 that interacts with KRAS (Margarit et al. 2003 Cell 112 5 685-695) onto the heptad distribution. We matched the heptad positions with the stapled SOS1 helical peptide produced by Leshchiner et al. (PNAS 2015 112 (6) 1761-1766) and set the stapled side of the peptide to form the hydrophobic interface with the rest of the TPR protein (FIG. 3A). The length of the helix is important. An N-terminal solvating CTPR helix ends in the sequence DPNN, which forms a short loop that leads into the next repeat. CTPR-mediated "stapling" (constraining) of binding helices therefore occurred through residues Tyr (i)-Ile (i+4)-Tyr (i+7)-Leu (i+11), fully stapling a 15-residue helix.

We created a hydrophobic interface between the grafted helix and the adjacent repeat and allowed the formation of the DPNN loop at the C-terminal end of the grafted helix. We then grafted the final sequence onto the crystal structure of a CTPR B helix for further validation of the interaction. Our designed KRAS-binding protein, SOS1-TPR, was docked against KRAS using the Haddock software (de Vries & Bonvin 2011; de Vries et al. 2010). Haddock is a data-driven docking algorithm that uses known information about the interaction for its calculations. The crystal structure of SOS1-KRAS (PDB: 1NVU) (Margarit et al. 2003) was originally used to design the stapled peptide. The active (primary interaction residues) and the passive (5 Å proximity to active) residues were extracted and inputted into the calculations.

Docking is not necessary to validate helical grafted scaffold. The geometry of α-helices permits selection of amino acid positions of the scaffold that accommodate outward facing target binding residues of the peptide ligand. TPR repeat scaffolds are exceptional for display of binding helices, as they grow linearly in the opposite direction of the helix, thereby avoiding steric clashes with the target protein.

Figure 3B:
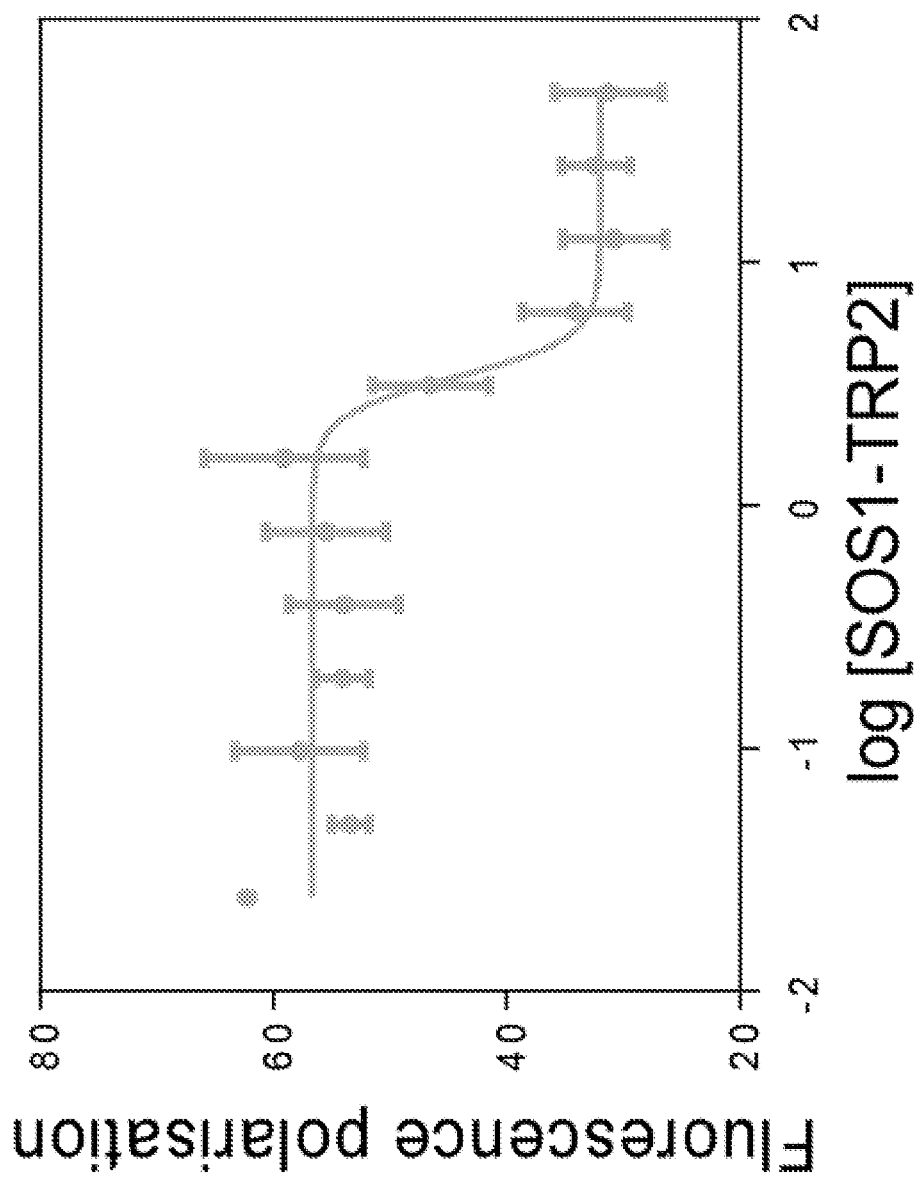
FIG. 3B shows binding of SOS-TPR2 to KRAS measured by competitive fluorescence polarization (FP). The complex between mant-GTP and KRAS was pre-formed, and 0.1-300 µM SOS-RTPR2 was then titrated in to the complex, displacing the mant-GTP from KRAS resulting in a decrease in FP. EC50 is 3 µM.

KRAS binding of the grafted scaffold can be assessed using the change in fluorescence polarisation of mant-GTP (2'-/3'-O—(N'-Methylanthraniloyl) guanosine-5'-O-triphosphate), a fluorescent analog of GTP (FIG. 3B). The fluorescence of mant-GTP is dependent on the hydrophobicity of its environment (excitation at 360 nm, emission at 440 nm). An increase in fluorescence intensity and fluorescence polarization was observed previously upon binding to KRAS (Leshchiner et al. 2015). SOS-TPR2 was then titrated into the preformed mant-GTP-KRAS complex. There was a clear decrease in polarisation with increasing concentrations of SOS-TPR2, indicating displacement of mant-GTP upon binding of SOS-TRP2 to KRAS (FIG. 3B). Fitting the data gave an EC50 of 3.4 µM. In contrast, a blank protein, CTPR3, had no effect on the fluorescence polarisation.

2.1.2 p53-TPR. A Helix-Grafted Binding Module Designed to Bind to Mdm2

Figure 4A:
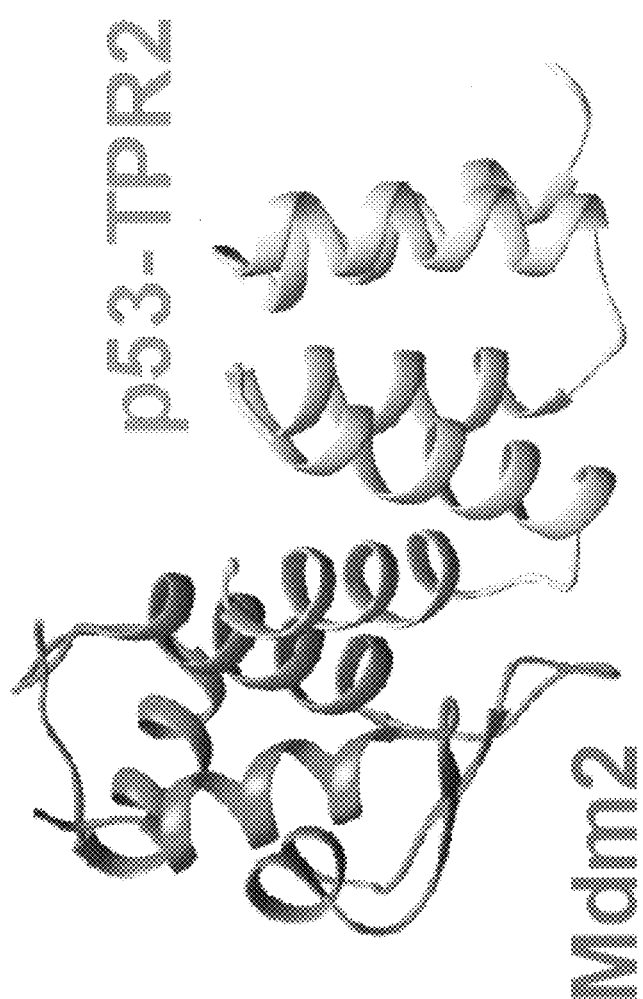
FIG. 4A shows the modelled structure of the Mdm2 (Mouse double minute 2 homolog) N-terminal domain in complex with the p53-TPR2 comprising the Mdm2-binding helix of p53 grafted onto a helix at the C-terminus of a CTPR2 protein.

Many degrons (region within the substrate that is recognized by the E3 ubiquitin ligase) are unstructured. However, p53 binds to the Mdm2 E3 through an alpha helix (FIG. 4A). Stapled versions of the p53 helix, as well as circular peptides and grafted coiled coils, have been developed by many groups, and the sequences have been optimised to give nanomolar affinities in some cases (see for example, Ji et al. 2013; Lee et al. 2014; Kritzer et al. 2006). The p53 helix has a favourable geometry to be grafted onto the C-terminal solvating helix of the CTPR scaffold, and moreover the two helices have 30% sequence identity.

Figure 4B:
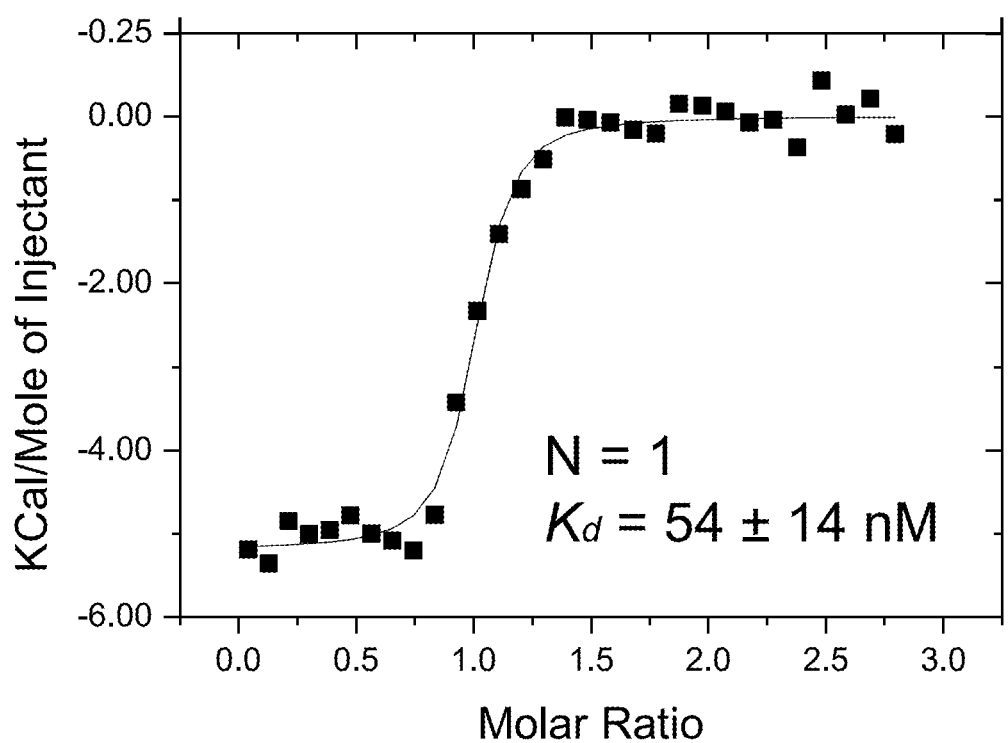
FIG. 4B shows an ITC analysis of the interaction between p53-TPR2 and Mdm2 N-terminal domain. The N-terminal domain of Mdm2 was titrated into the cell containing 10M p53-TPR2.

Proof of binding of p53-CTPR2 to Mdm2 (N-terminal domain) was obtained using isothermal titration calorimetry (ITC). Mdm2 was titrated into a solution containing 10 µM of p53-TPR2. ITC measures the heat released upon binding. A high-affinity interaction was observed with a dissociation constant of approximately 50 nM (FIG. 4B).

2.2. Demonstration of Proteins with a Single Binding Function Grafted onto an Inter-Repeat Loop 2.2.1 TPB2-TPR. A Loop Module Designed to Bind to Oncoprotein Tankyrase First, we introduced the SLiM "3BP2", a sequence that binds to the substrate-binding ankyrin-repeat clusters (ARC) of the protein tankyrase, a multi-domain poly ADP-ribose polymerase that is upregulated in many cancers (Guettler et al. 2011) onto the CTPR scaffold. Grafting SLiMs in folded domains led to an increase of proteolysis resistance; showing the potential to expand the interaction surface through further rational engineering, in silico methods and/or directed evolution; controlled geometric arrangement; and bi- or multivalency of interactions.

Figure 5A:
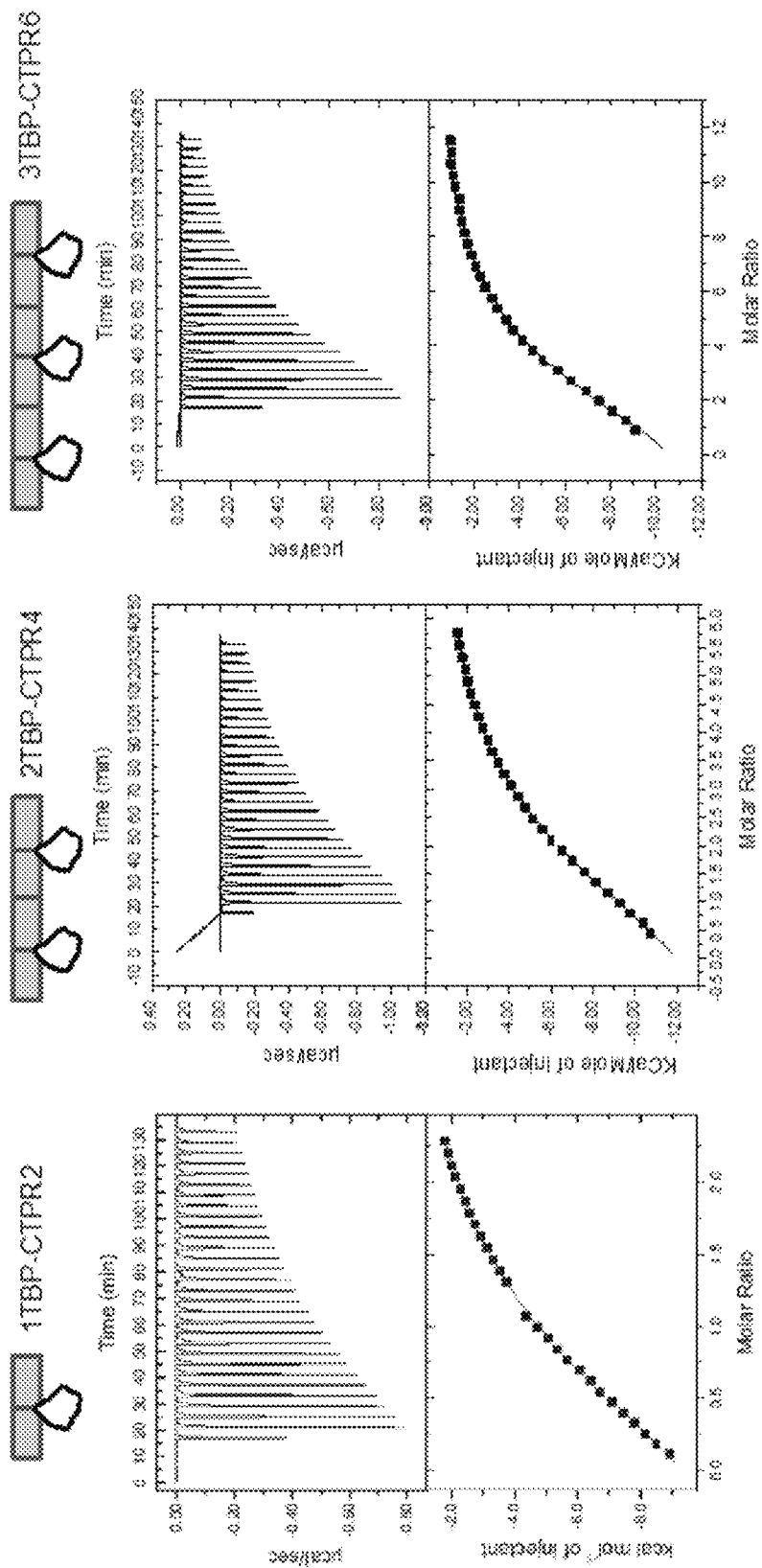
FIG. 5A shows an ITC analysis of the interaction between a series of tankyrase-binding loop-grafted CTPR2 proteins (TBP-CTPR2) and the substrate-binding ARC4 (ankyrin-repeat cluster) domain of tankyrase. There is an enhancement of both binding affinity and dissociation constant with increasing number of binding modules.

We tested the binding of 1TBP-CTPR2, 2TBP-CTPR4 and 3TBP-CTPR6 to the ARC4 domain of tankyrase using ITC (Figure. 5A). This technique is particularly useful for these interactions, as it can measure the stoichiometry (n) of the interaction. We showed that n increased with the number of binding loops, meaning that there were as many tankyrase molecules bound to one TBP-CTPR as loops in the protein. Thus, all loops are accessible to the binding partner. Moreover, the binding affinity increases and the off rate decreases with the number of repeats indicative of an avidity effect. This type of multivalent molecule would be particularly useful for full-length tankyrase, as it has four ARC domains capable of binding the 3BP2 peptide.

Figure 5B:
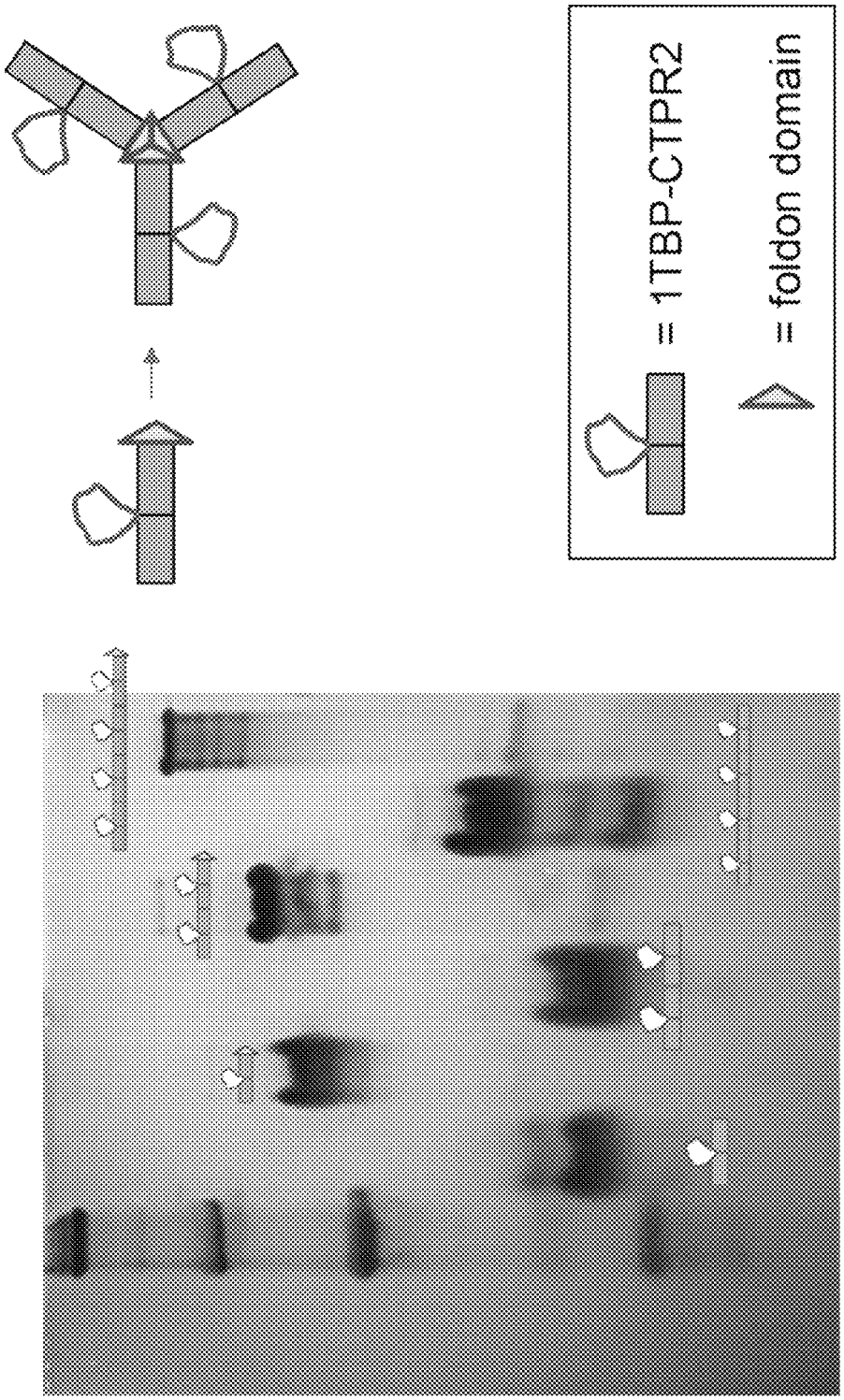
FIG. 5B shows native gel analysis (using a native gel in Tris-Glycine buffer pH 8.0, 40 µM protein concentration) of multivalent TBP-CTPR proteins expressed as fusion constructs with the foldon trimerisation domain (Boudko et al 2002; Meier et al. 2004). 1TBP-CTPR2, 2TBP-CTPR4 and 4TBP-CTPR8 (all lacking the foldon domain) were purified and run as monomeric controls. Constructs having the foldon domain run at much higher molecular weights than their monomeric counterparts.

Multivalency in this system was increased further via oligomerisation of the binding modules by fusing them to the foldon domain of T4 fibritin (FIG. 5B). This trimerisation domain comprises of a C-terminal helix, such as that of p53-CTPR, ending with the foldon domain, a short β-sheet peptide capable of homo-trimerising. The foldon domain has been shown to be highly stable and independently folded (Boudko et al 2002; Meier et al. 2004). In this way, multiple binding modules can be arranged with specified geometries to inhibit complex multivalent molecules that cannot be targeted with monovalent interactions due to their natural tendency to interact with other multivalent networks with high avidity.

2.2.2 Effect of Introducing Multivalency into a Single Binding Function TPR

Figure 17:
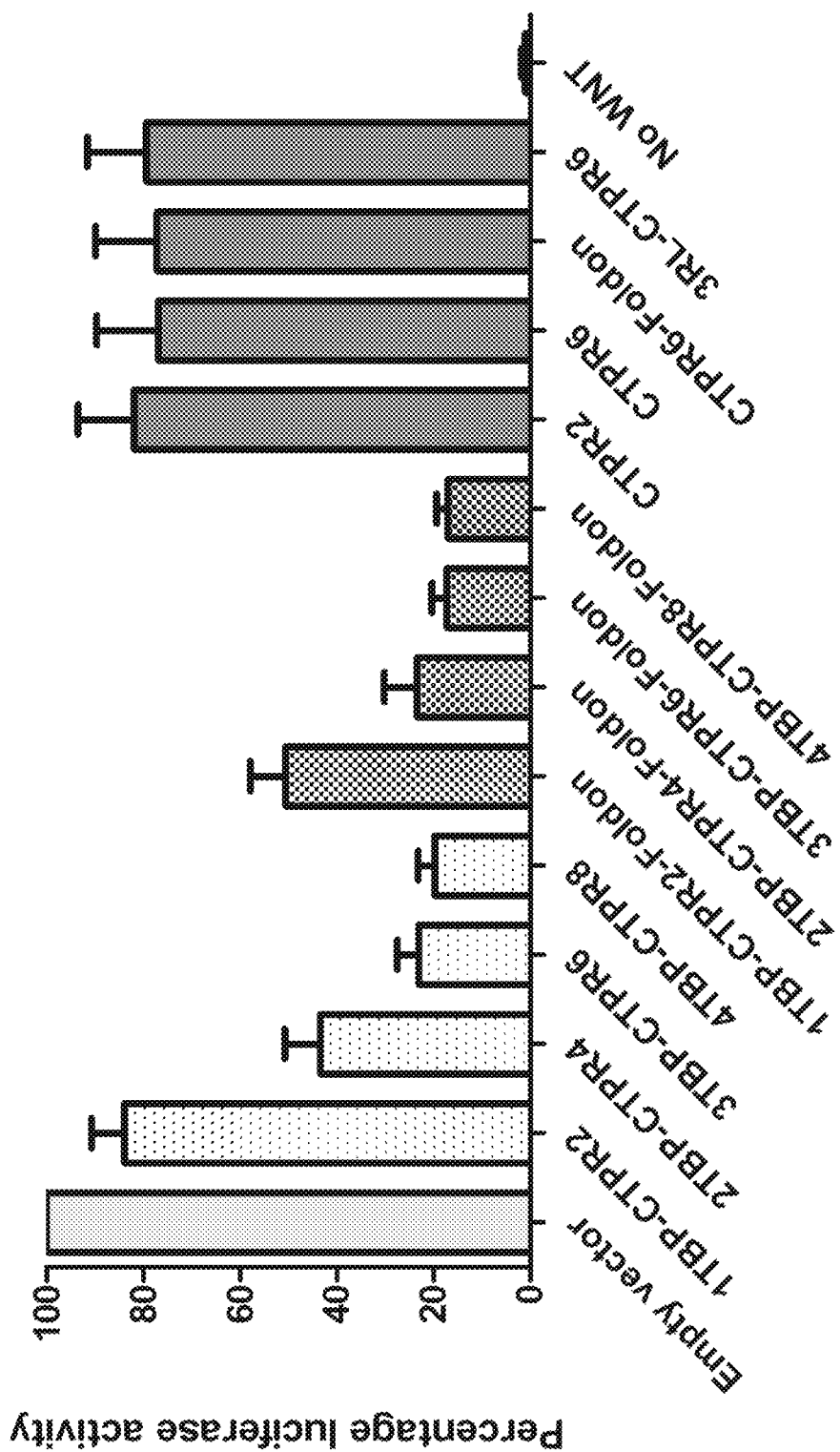
FIG. 17 shows the effect of designed multi-valent tankyrase-binding TPR proteins on Wnt signalling. HEK293T cells were transfected with TPR-encoding plasmids using Lipofectamine2000. The TPR proteins contained 1-4 copies of a tankyrase-binding peptide (TBP) grafted onto the inter-repeat loop(s). For example, 2TBP-CTPR4 is a protein comprising 4 TPR modules with one TBP grafted onto the loop between the first and second TPR and one between the third and fourth TPR. 'Foldon' indicates a trimeric TPR-foldon fusion protein.

We tested the function of multi-valent CTPR proteins containing variable numbers of the "3BP2" motif that binds to the protein tankyrase. (LTBP-CTPR2, 2TBP-CTPR4 and 3TBP-CTPR6 etc.). Multi-valency was increased further via oligomerisation of the TPRs by fusing them to the foldon domain of T4 fibritin (1TBP-CTPR2-Foldon, 2TBP-CTPR4-Foldon etc.). The inhibitory effect of the TBP-grafted TPRs was assayed using a beta-catenin reporter gene assay (TOPFLASH assay). Increasing the number of functional units increased the inhibitory effect of the proteins, as mentioned using a Wnt signalling assay (FIG. 17).

Figure 6A:
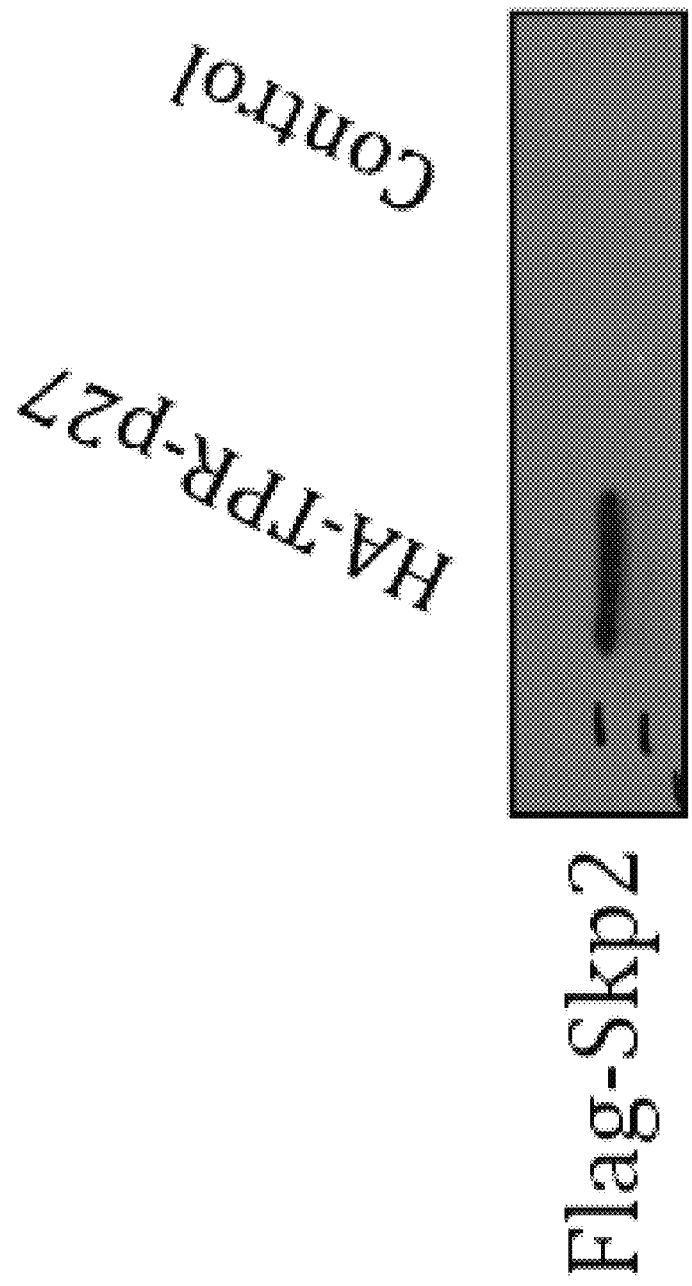
FIG. 6A shows that HA-CTPR2-p27 is able to co-IP FLAG-Skp2 from HEK293T cells.
Figure 6B:
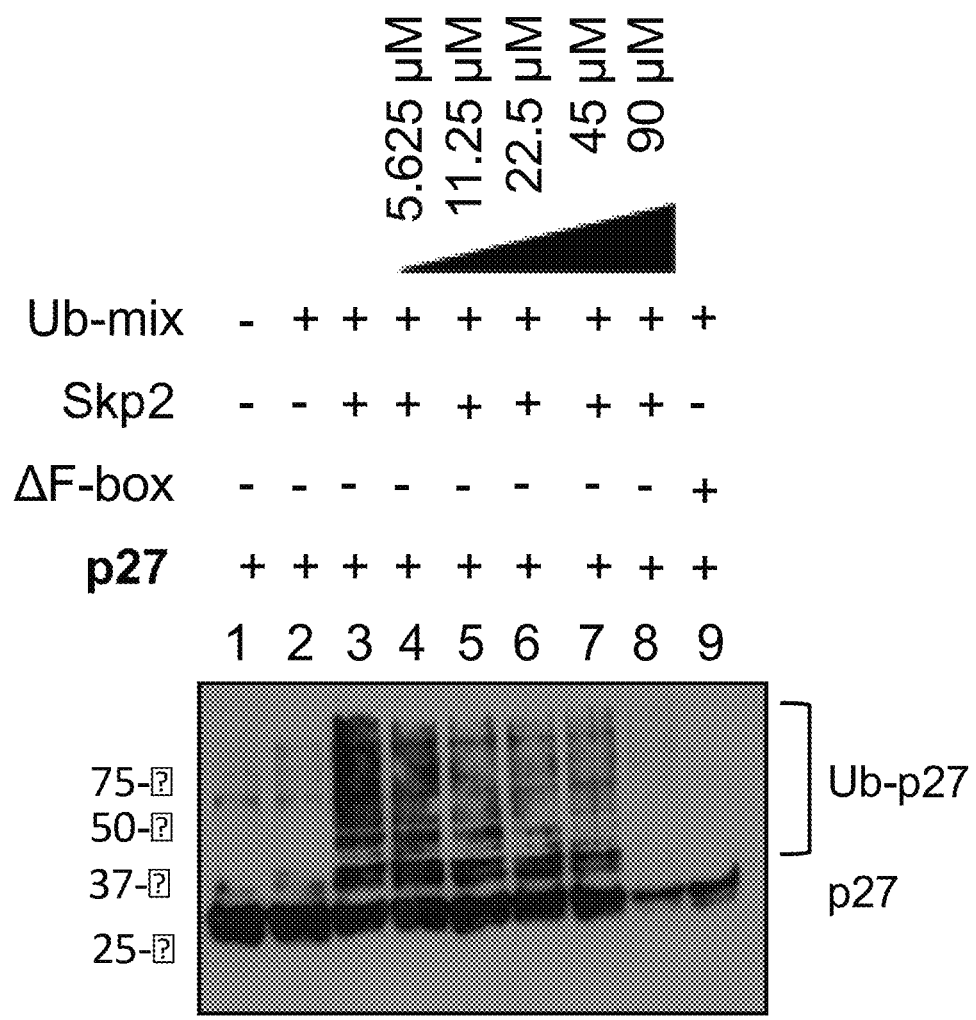
FIG. 6B shows E. coli-expressed and purified TPR5-p27 inhibits p27 ubiquitination in vitro.

2.2.3 Skp2-RTPR, a Loop Module Designed to Bind to E3 Ubiquitin Ligase SCF$^{Skp2}$ Skp2 is the substrate recognition subunit of the SCF$^{Skp2}$ubiquitin ligase. The Skp2-binding sequence that we inserted into the RTPR loop was based on the previously published degron peptide sequence derived from the substrate p27 that binds to Skp2 in complex with Cks1 (an accessory protein) (Hao et al. 2005). We used only 10 residues of this peptide. Although ideally the Skp2-binding sequence would include a phospho-threonine (as this residues makes some key contacts with Skp2 and Cks1), we instead explored whether we could replace the phospho-threonine with a phosphomimetic (glutamate) without affecting binding affinity. We found using co-immunoprecipitation that the resulting p27-TPR protein was able to bind to Skp2 (FIG. 6A) and that it was able to inhibit the ubiquitination of p27 in vitro with a high efficiency indicating a dissociation constant of the order of 30 nM (FIG. 6B). As the peptide adopts a turn-like conformation in its Skp2/Cks1-bound state, constraining it within the RTPR scaffold leads to a large enhancement in binding affinity that outweighs any loss in affinity arising from replacing the phosphothreonine with a phosphomimetic.

2.2.4 Nrf-TPR. A Loop Module Designed to Bind to E3 Ubiquitin Ligase Keap1-Cul3

Figure 7A:
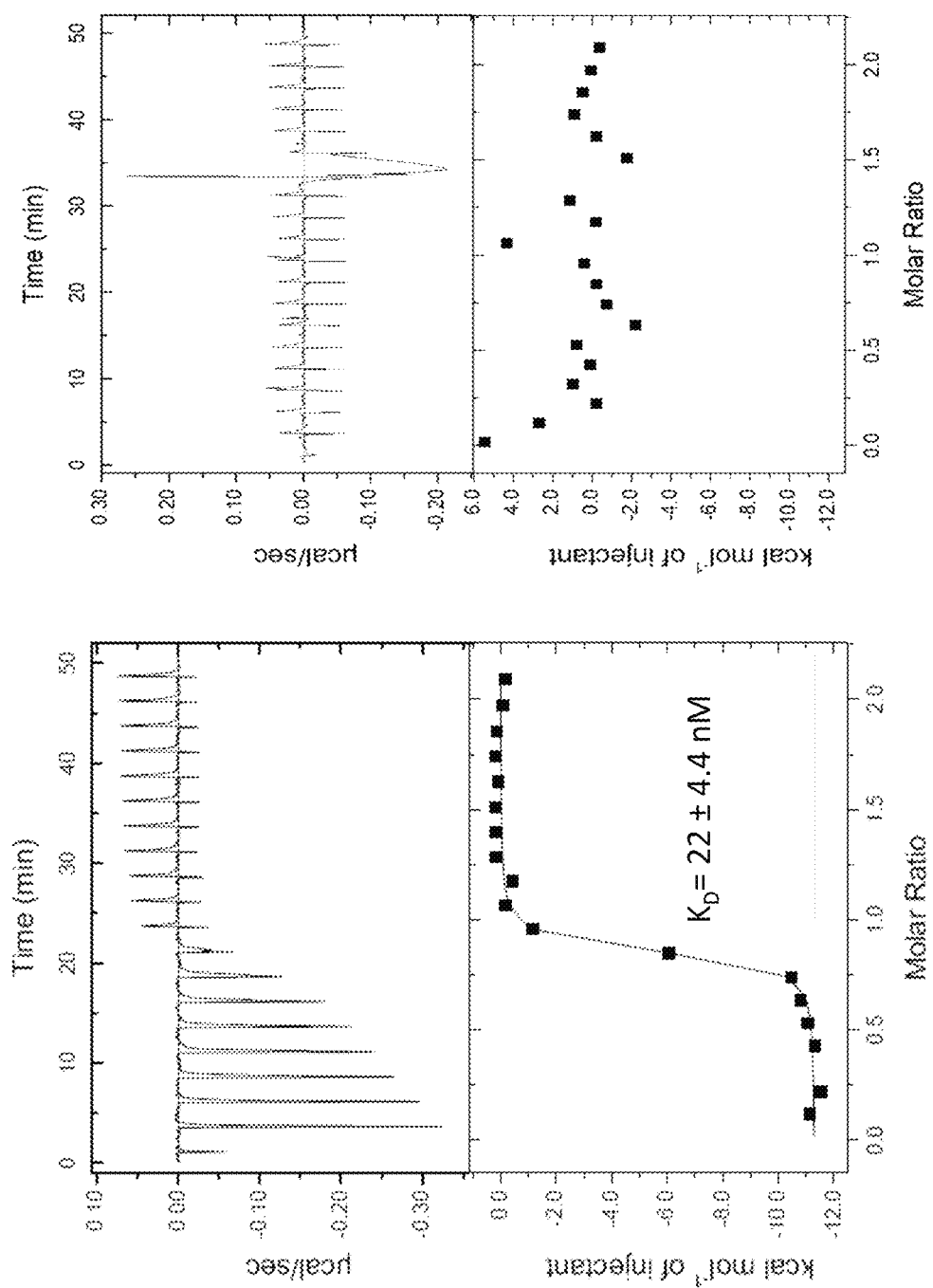
FIG. 7A shows (left) ITC analysis of the interaction between the Keap1 (Kelch-like ECH-associated protein 1) KELCH domain and a CTPR2 protein containing a loop-grafted Keap1-binding sequence derived from the protein Nrf2 (Nuclear factor (erythroid-derived 2)-like 2) (Nrf-CTPR2). No binding is observed for the blank CPTR2 protein (right).
Figure 7B:
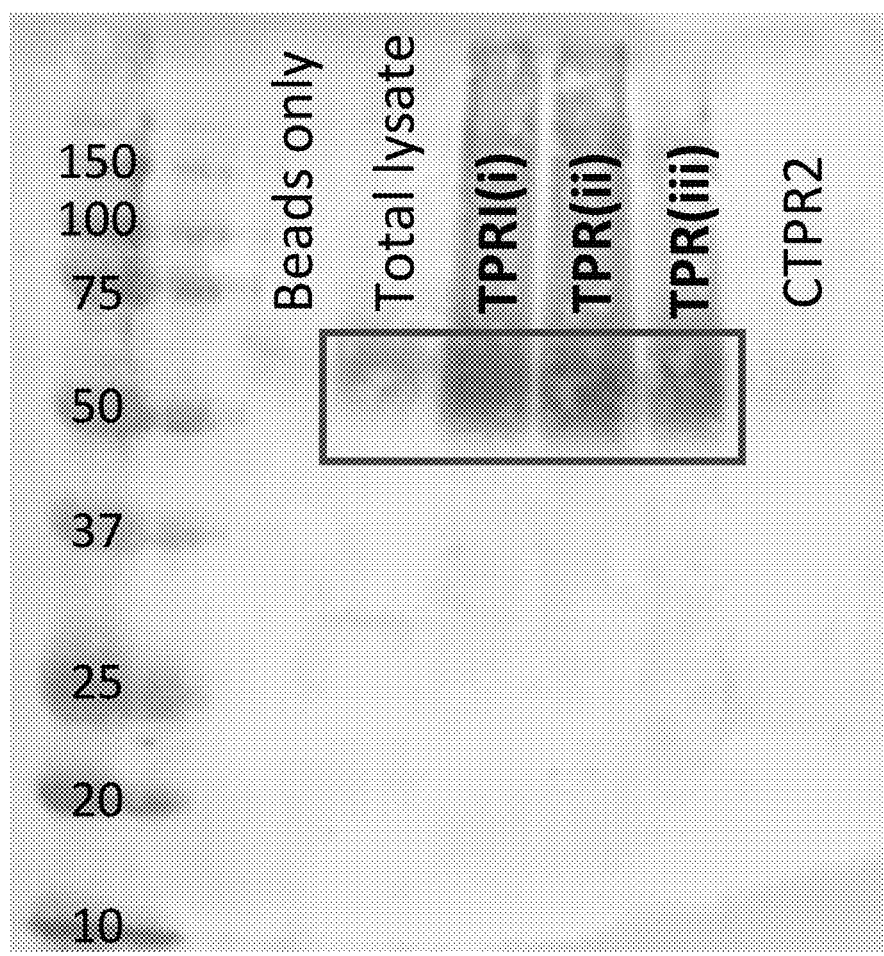
FIG. 7B shows that three variants of Nrf-CTPR2 (Nrf-CTPR2 (i), Nrf-CTPR2 (ii), Nrf-CTPR2 (iii) can co-IP Keap1 from HEK293T cells.

Keap1 is the substrate recognition subunit of the Keap1-Cul3 ubiquitin ligase. A Keap1-binding sequence that we inserted into the CTPR loop was based on the previously published degron peptide sequence derived from the Keap1 substrate Nrf2. We found using co-immunoprecipitation that the resulting Nrf-TPR protein was able to bind to Keap1 (FIG. 7A) and that the interaction had a high affinity in the low nanomolar range as measured by ITC analysis (FIG. 7B).

2.3. Engineering the RTPR Scaffold for Delivery into the Cell

Figure 8:
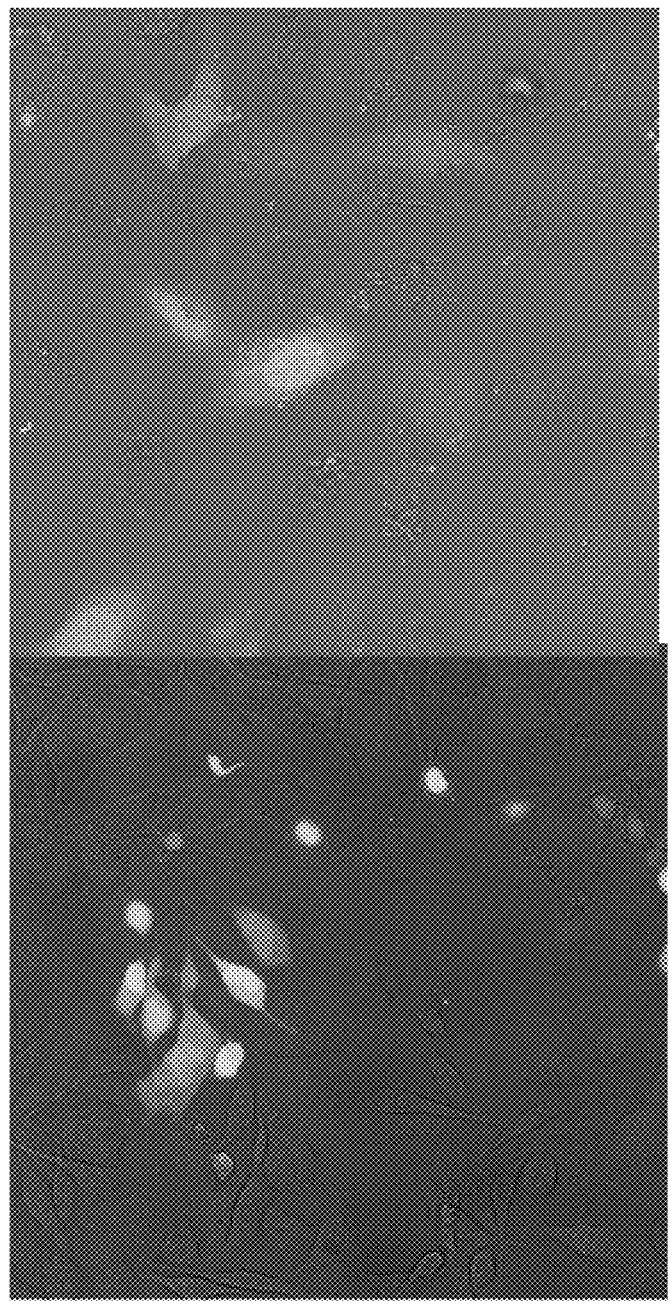
FIG. 8 shows live-cell imaging of intracellular delivery of an RTPR achieved by resurfacing (by introducing Arginine residues at surface sites). PC3 (left) and U2OS (right) cells incubated with 10 µM FITC-labelled resurfaced TBP-RTPR2 for 3 hours at 37° C., 5% $CO_2$. Overlay of DIC (differential interference contrast) and confocal image. Intracellular fluorescence was also observed at lower concentrations of protein.

Combining our RTPR sequences with an alternative consensus TPR sequence (Parmeggiani et al. 2015) we included additional solvent-exposed Arginine residues, as such 'resurfacing' or 'supercharging' has been shown previously to facilitate the entry of proteins into cells (Chapman & McNaughton 2016; Thompson et al. 2012). FIG. 8 shows that this approach was successful in delivering a fluorescent-labelled resurfaced TBP-RTPR2 protein into two different cell lines.

2.4. Design of Hetero-Bifunctional TPRs to Direct Proteins for Ubiquitination and Subsequent Degradation The Wnt/β-catenin signalling pathway is deregulated in many cancers and in neurodegenerative diseases, and therefore β-catenin is an important drug target. There are a large number of known binding sequences (both helical and non-helical) for β-catenin that appear suitable for grafting onto the TPR scaffold, and therefore we chose it as the first target for our design of hetero-bifunctional TPRs to induce protein degradation. We selected Mdm2 and SCF$^{Skp2}$ to test as E3 ubiquitin ligases, as we had successfully generated single-function TPRs to bind to them (FIGS. 4 and 6). We generated structural models of some of the hetero-bifunctional molecules and used these as a crude assessment of whether the resulting presentation of β-catenin to the E3 looked appropriate. We then generated a small library of plasmids encoding proteins comprising three or four TPRs functionalized with different combinations of the β-catenin-binding module and the two E3 ligase-binding modules.

Figure 9A:
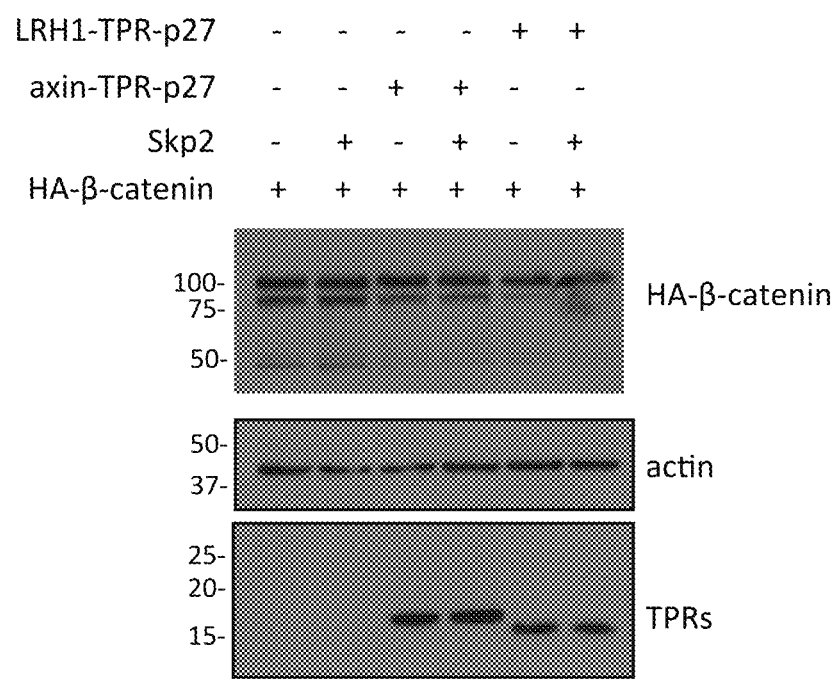
FIG. 9A shows the beta-catenin levels in cells transfected with either HA-tagged beta-catenin plasmid alone or HA-tagged beta-catenin plasmid together with one of two different hetero-bifunctional RTPR plasmids (LRH1-TPR-p27 and axin-TPR-p27, designed to bind simultaneously to beta-catenin and to E3 ligase $SCF^{Skp2}$).
Figure 9B:
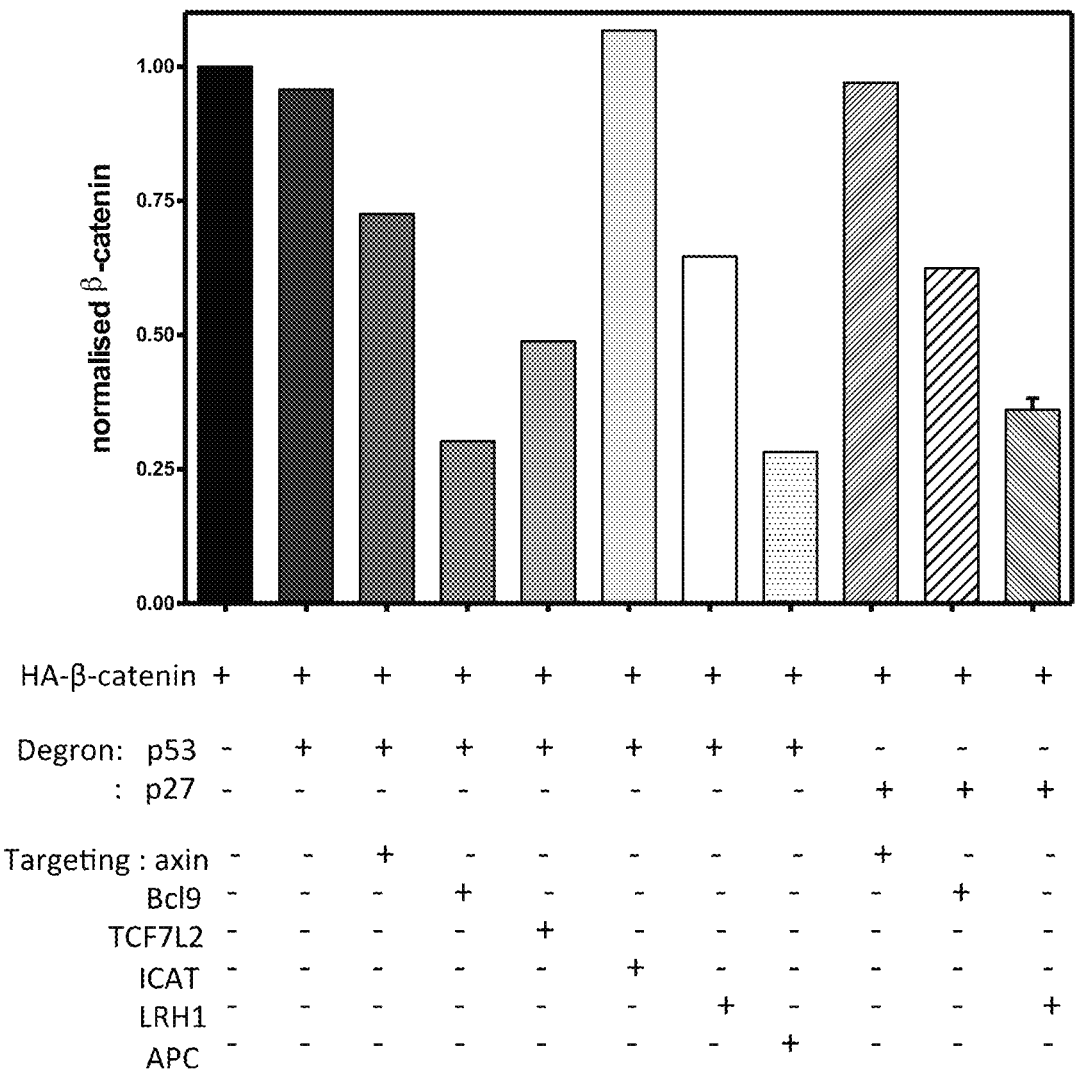
FIG. 9B shows a quantitative analysis of the beta-catenin levels in the presence of different hetero-bifunctional RTPRs designed to bind simultaneously to beta-catenin and to either E3 ligase $SCF^{Skp2}$ or E3 ligase Mdm2. The analysis was performed using densitometry of the bands detected by Western blots corresponding to HA-tagged beta-catenin normalised to actin bands using ImageJ. Negative controls used were single-function TPRs or blank (non-functional) TPRs.

We transfected HA-tagged β-catenin plasmid alone or HA-tagged β-catenin plasmid together with one of the various hetero-bifunctional TPR plasmids in HEK293T cells using Lipofectamine2000. After 48 hours of transfection, the cells were lysed, the sample was boiled and proteins were resolved by SDS-PAGE and immunoblotting was performed using anti-HA and anti-actin antibodies. Changes in β-catenin levels were evaluated by the densitometry of the bands corresponding to HA-β-catenin normalised to actin levels (FIG. 9). The results show that a number of the hetero-bifunctional molecules are capable of reducing β-catenin levels by up to 70%. In contrast, neither a blank TPR nor single-function TPRs have any effect on β-catenin levels.

A range of different factors contribute to efficient ubiquitination and target degradation by these hetero-bifunctional molecules, hence the power of screening different combinations of single-function modules and potentially also different lengths of intervening blank modules.

2.5 Using a Delivery Vehicle to Introduce the Modular TPR Proteins into Cells

Figure 18:
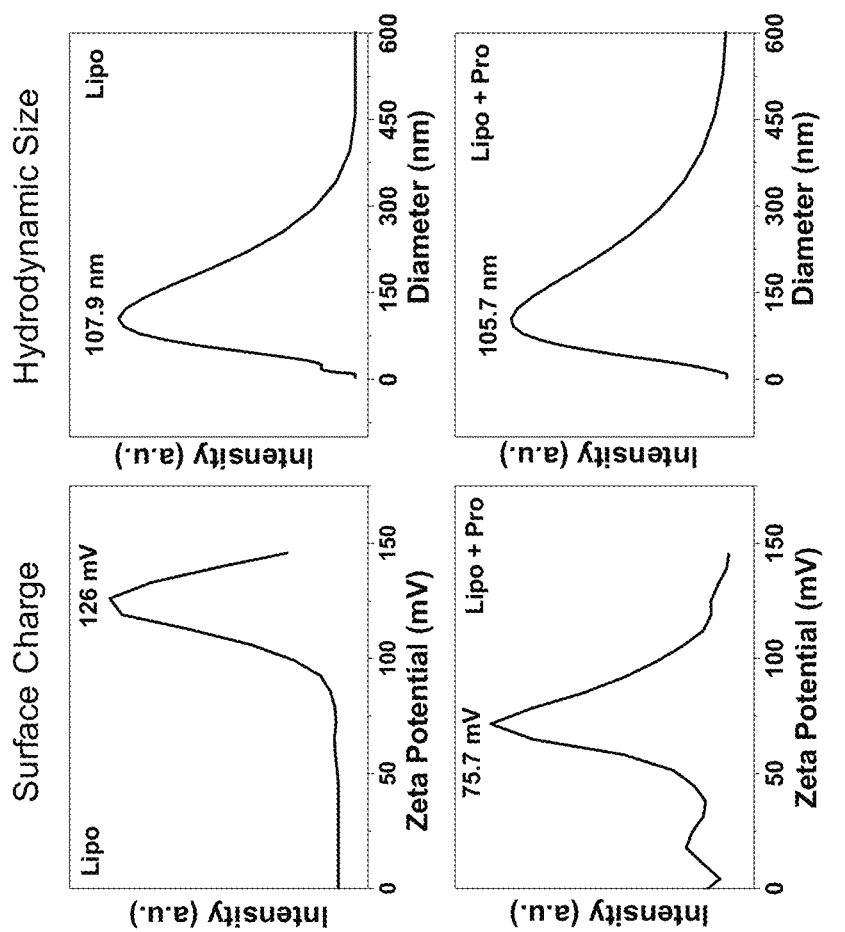
FIG. 18 shows characterisation of the size and charge of liposome-encapsulated TPR proteins.
Figure 19:
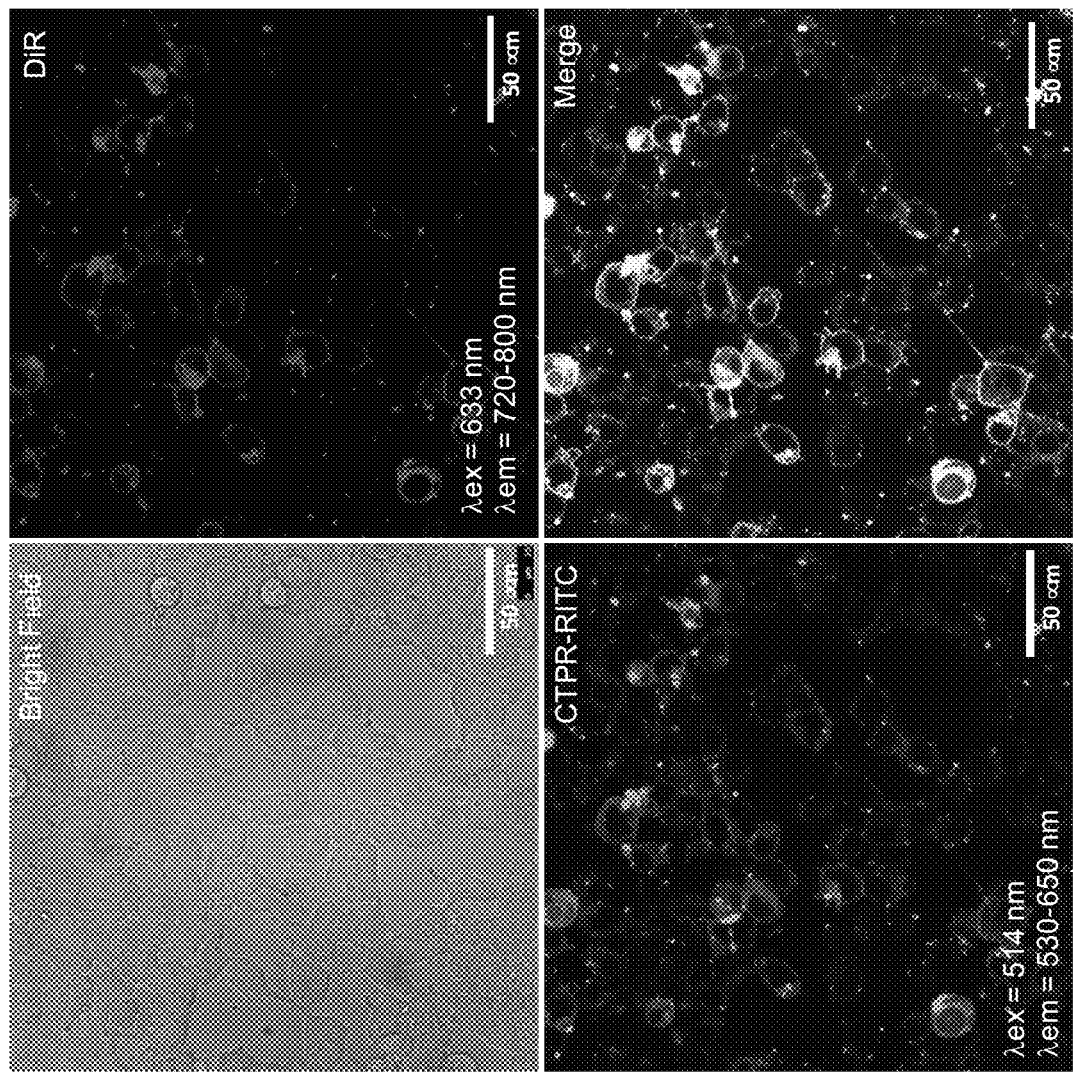
FIG. 19 shows the delivery of TPR proteins into cells by liposome encapsulation. FITC dye-labelled liposomes stain the cell membrane upon membrane fusion (red panel), and RITC-labelled TPR protein cargo is then delivered into the cytoplasm. The green panel and red-green merge show that the proteins have entered the cells and are spread diffusely in the cytoplasm.
Figure 20:
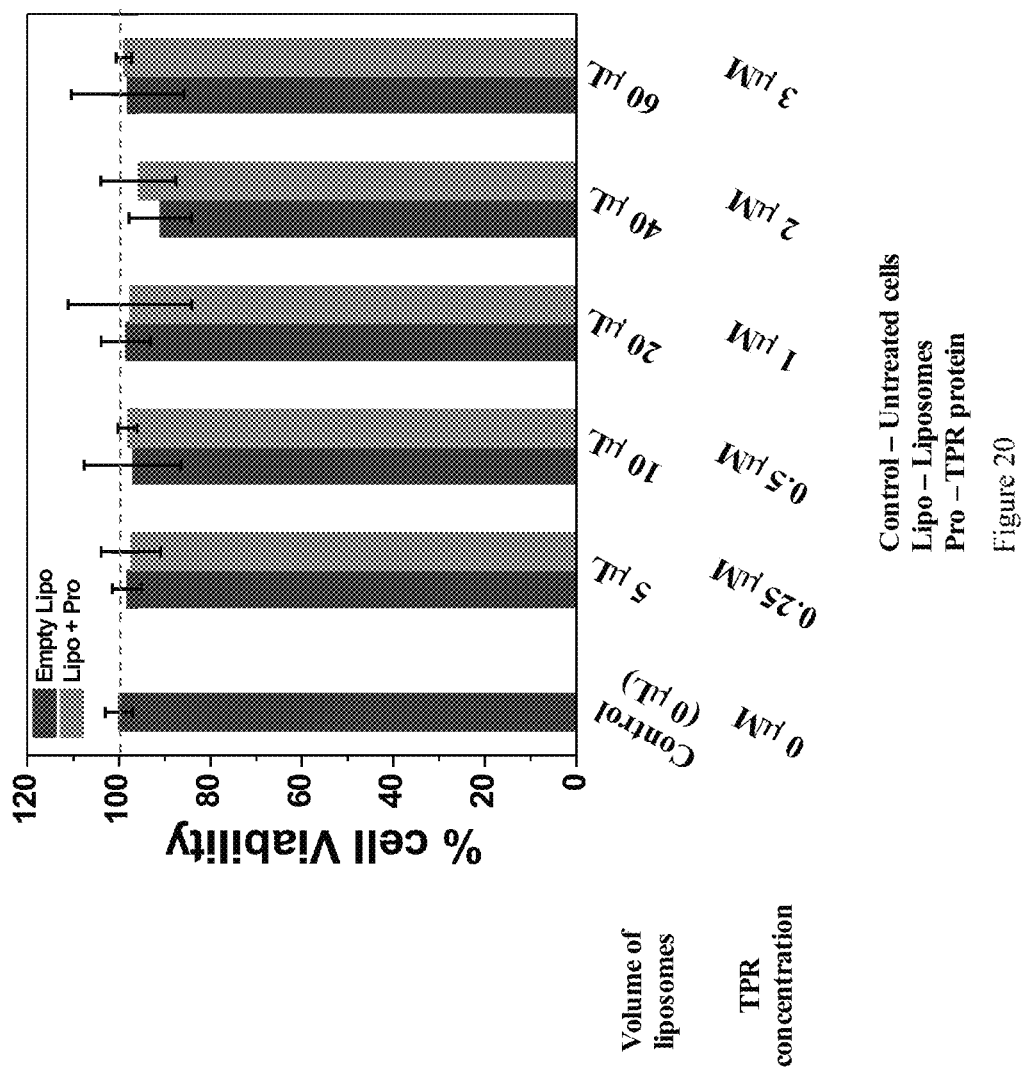
FIG. 20 shows that liposome-encapsulated TPR proteins are not toxic to HEK293T cells at the concentrations used.

We encapsulated the designed TPR proteins within fusogenic liposomes made from cationic, neutral, and aromatic lipids, and we showed that they were thereby delivered into cells (FIGS. 18 and 19). Empty liposomes and liposomes encapsulating TPR proteins are not toxic to the cell (FIG. 20).

Figure 21:
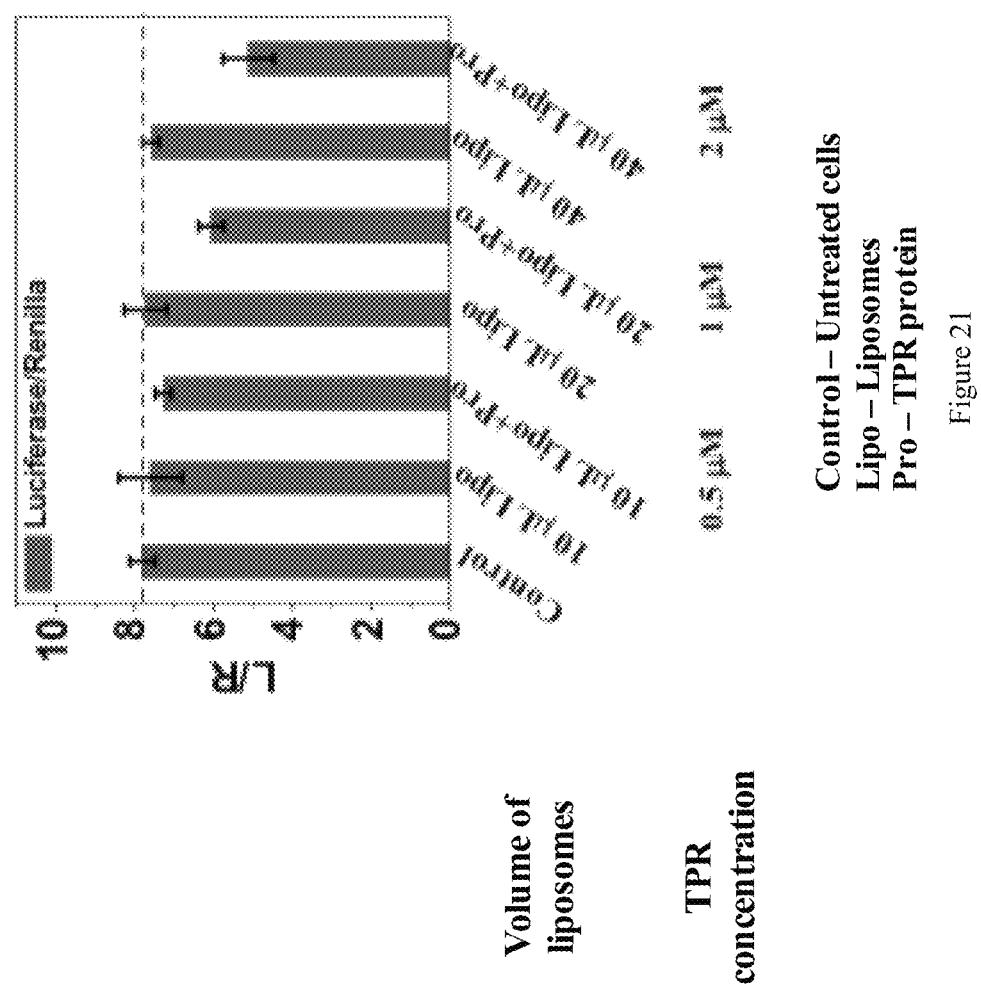
FIG. 21 shows the effect of designed TPR proteins delivered by liposome encapsulation. The TPR proteins contained a tankyrase-binding peptide. Cells were treated with liposomes for 2 hr.
Figure 22:
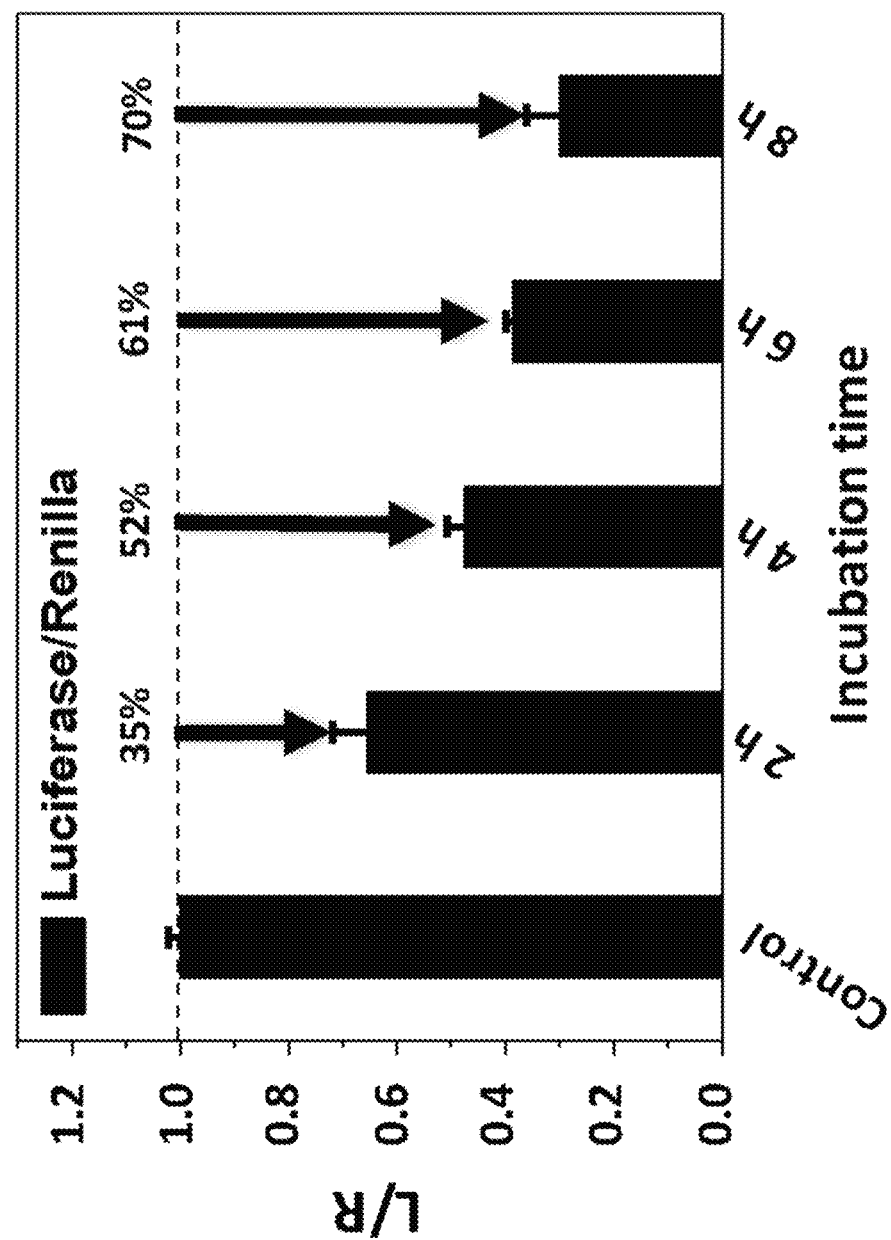
FIG. 22 shows the effect of designed TPR proteins delivered by liposome encapsulation. Cells were treated with liposomes encapsulating 32 µg protein for variable times (2-8 h) indicated in the figure.
Figure 23:
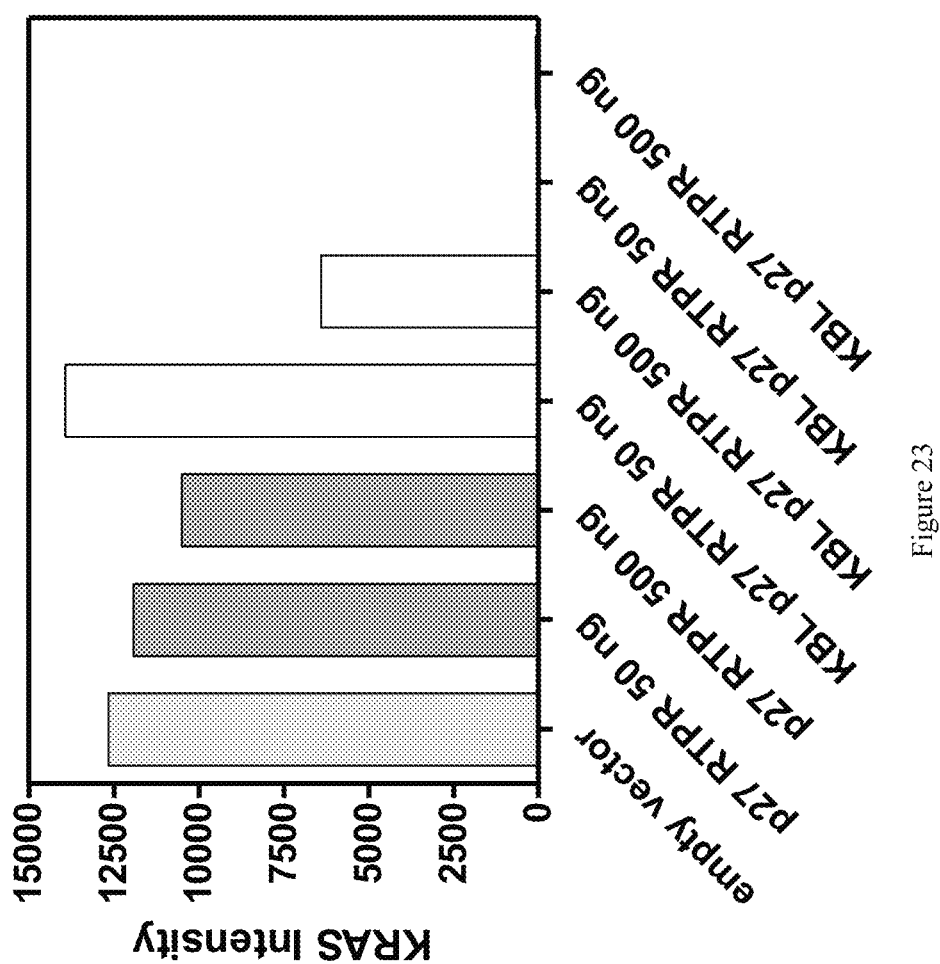
FIG. 23 shows the effect of designed hetero-bifunctional TPR proteins on KRAS levels in HEK 293T cells. The TPR proteins contained a binding sequence for KRAS (a non-helical peptide sequence, referred to as KBL, grafted onto an inter-repeat loop of the RTPR) and a degron derived from p27 grafted onto another inter-repeat loop. Cells were transiently transfected with 50 ng or 500 ng of TPR encoding plasmids, as indicated, and with KRAS plasmid or empty vector as control. 24 hours post transfection the cells were lysed, and KRAS levels were evaluated by western blot. In dark grey are cells treated transfected with single-function TPR plasmid (containing degron only).

2.6 Further Examples of Hetero-Bifunctional TPRs to Direct Proteins for Ubiquitination and Subsequent Degradation TPR proteins were designed to target either tankyrase (FIG. 21, FIG. 22) or KRAS (FIG. 23). TPR proteins targeting tankyrase or were delivered into cells using liposome encapsulation, and the effect on Wnt signalling was assayed using a TOPFLASH assay. The results show that the TPR proteins are able to inhibit Wnt signalling. For KRAS, we transfected KRAS plasmid alone or KRAS plasmid together with one of the TPR plasmids in HEK293T cells using Lipofectamine2000. 24 hours post transfection the cells were lysed, and KRAS levels were evaluated by western blot. The results show that the designed hetero-bifunctional TPR is capable of reducing KRAS levels.

2.7 Hetero-Bifunctional TPRs to Direct KRAS for Degradation Via Chaperone-Mediated Autophagy (CMA)

Figure 24:
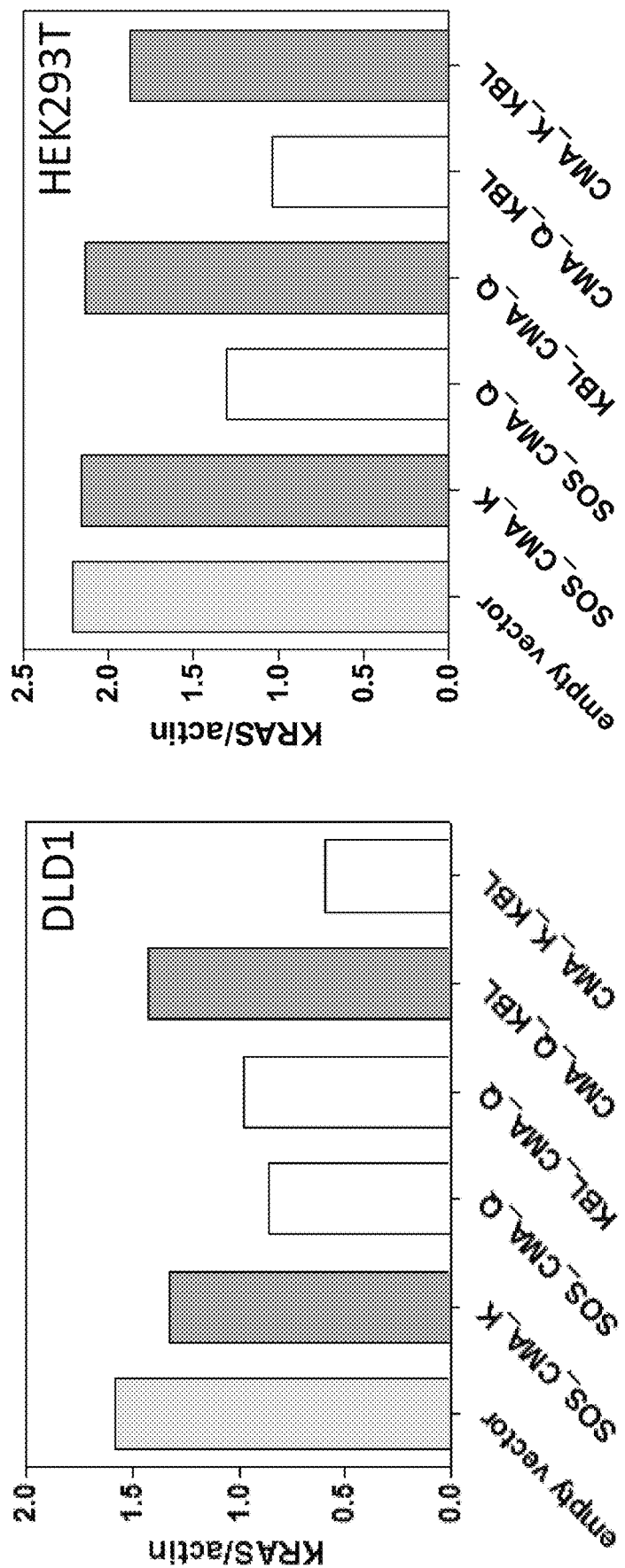
FIG. 24 shows the effect of hetero-bifunctional TPR proteins targeting endogenous KRAS to the CMA (chaperone-mediated autophagy) pathway. The TPR proteins contained a binding sequence for KRAS (either a grafted helix derived from son-of-sevenless-homolog 1 (SOS) or a non-helical peptide sequence (referred to as 'KBL') displayed in a loop of the RTPR) and targeted for degradation using two different chaperone-mediated autophagy peptides (referred to as 'CMA_Q' or 'CMA_K') at the N- or C-terminus of the construct. Constructs or empty vector (light grey) were transiently transfected into either HEK293T or DLD1 (colorectal cancer cell line). 24 hours post transfection the cells were lysed, and KRAS levels were evaluated by western blot. Those constructs that resulted in significant reduction in KRAS compared to the empty vector control are shown in white.

Hetero-bifunctional TPR proteins were designed to target endogenous KRAS for degradation via CMA (FIG. 24). TPR constructs or empty vector (light grey) were transiently transfected into either HEK293T or DLD1 (colorectal cancer cell line) using Lipofectamine2000. 24 hours post transfection the cells were lysed, and KRAS levels were evaluated by western blot. The designed hetero-bifunctional TPRs that resulted in reduction of KRAS levels compared to the empty vector control are shown in white.

Figure 25:
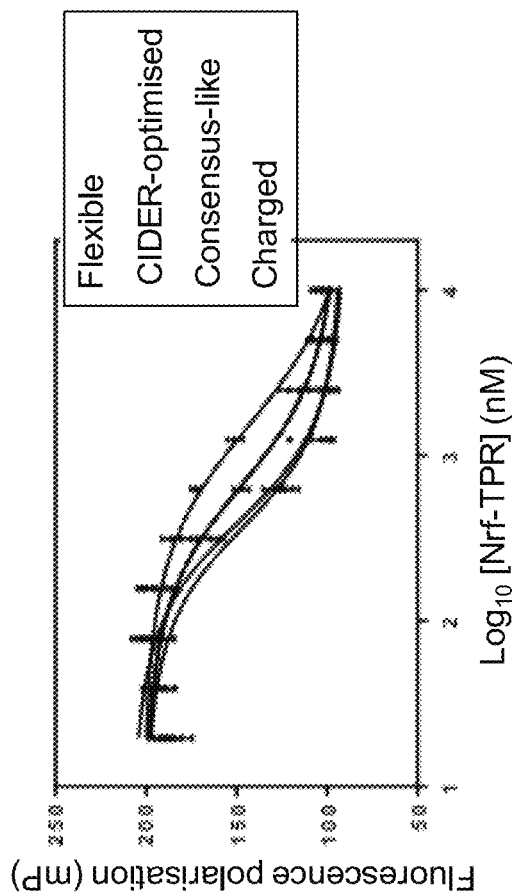
FIG. 25 shows examples of variations in the linker sequence connecting a peptide ligand to an inter-repeat loop in order to optimise the binding affinity for the target. The example shown is Nrf-TPR, a TPR protein designed to bind to Keap1 (see FIG. 7 of the original patent application). Glycine residues were introduced into the linker to provide flexibility and increased spatial sampling. The introduction of this more flexible linker sequence was found to increase the binding affinity of the Nrf-TPR protein (labelled 'Flexible') when compared with the consensus-like linker sequence. Altering the charge content of the linker sequence ('labelled 'Charged') and altering the conformational properties (based on the predictions of the program CIDER (Holehouse et al. Biophys. J. 112, 16-21 (2017)) of the loop by changing the amino acid composition of the linker sequence (labelled 'CIDER-optimised') also affected the Keap1-binding affinity.
Figure 26:
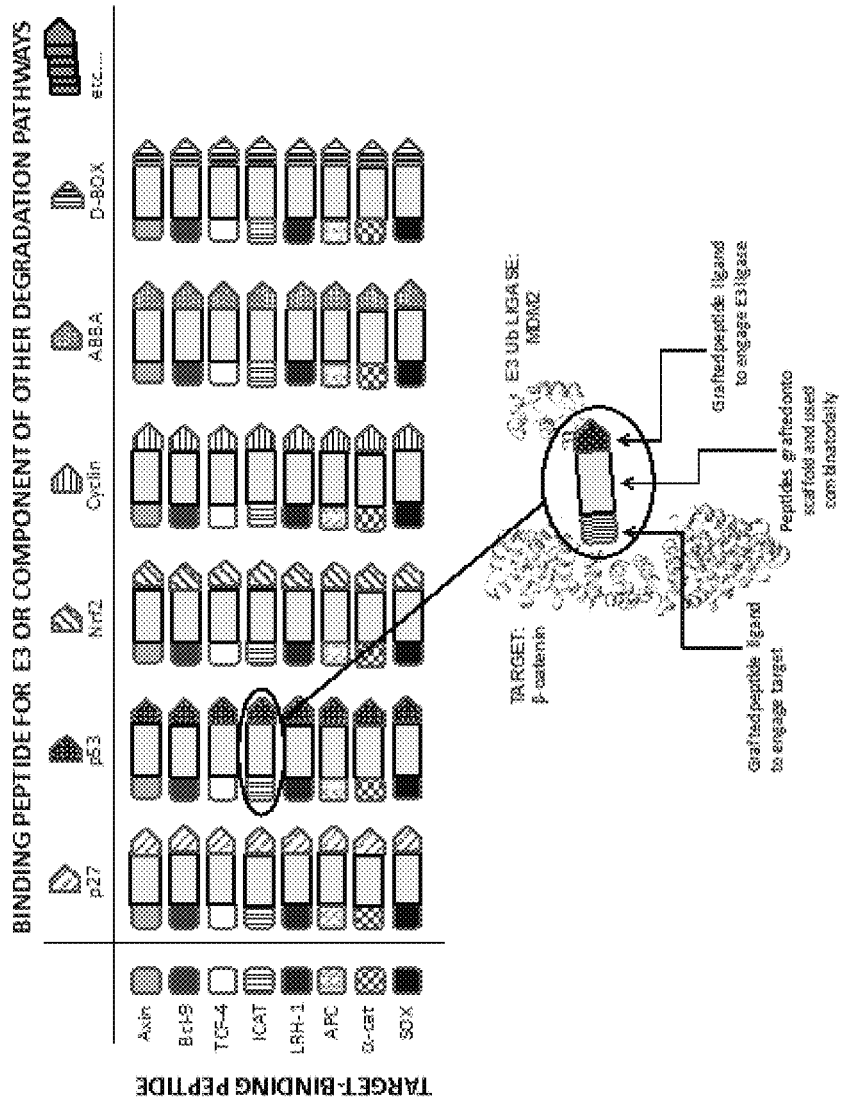
FIG. 26 shows the schematic representation of a matrix of degradation-inducing chimeric proteins. The matrix shown is for use in targeting β-catenin for degradation. These proteins comprise a scaffold (grey rectangles) onto which are grafted: (1) a target-binding peptide ligand and (2) a binding peptide for an E3 ubiquitin ligase or a component of another degradation pathway. Each of the target-binding peptides is derived from a different protein that interacts with β-catenin (see Table 2). Each of the degradation pathway-binding peptides (referred to as "degrons") is derived from a substrate or binding partner of one of many different E3s or from a binding partner for one of a component of another cellular degradation pathway (including chaperone-mediated autophagy, selective autophagy and ESCRT (endosome-lysosome) pathways); 'etc.' denotes the fact that there are many such proteins that can be harnessed for degradation, as detailed further in Table 3 The schematic illustrates the combinatiorial "plug-and-play" nature of these matrices, in terms of the ability to slot in any target-recruiting peptide and degradation-pathway-recruiting peptide. The other factor that can be varied in the matrix arises from the fact that the two peptides can also be grafted onto different positions in the scaffold so as to present the target in different configurations with respect to the E3 or other degradation machinery. Once the matrix is constructed, it can then be screened in cell-based assay in order to identify the best combination of two peptides and their positions within the scaffold that induces the greatest reduction in target protein levels. The same panel of diverse degradation pathway components can be used for screen for degradation of any target

2.8 Variations in the Linker Sequence Connecting a Peptide Ligand to an Inter-Repeat Loop The linker sequence connecting a peptide ligand to an inter-repeat loop was varied in order to optimise the binding affinity for the target for Nrf-TPR, a TPR protein designed to bind to the protein Keap1 (see FIG. 7). Glycine residues were introduced into the linker to provide flexibility and increased spatial sampling. The introduction of this more flexible linker sequence was found to increase the binding affinity of the Nrf-TPR protein (labelled 'Flexible') when compared with the consensus-like linker sequence altering the charge content of the linker sequence ('labelled 'Charged') and altering the conformational properties (based on the predictions of the program CIDER (Holehouse et al. Biophys. J. 112, 16-21 (2017)) of the loop by changing the amino acid composition of the linker sequence (labelled 'CIDER-optimised') also affected the Keap1-binding affinity (FIG. 25).

TABLE 1

| Targeted Ubiquitin Ligase | Degron sequence derived from | Targeted protein for Degradation | β-catenin-binding sequence derived from: | Scaffold |
| --- | --- | --- | --- | --- |
| Mdm2 | p53 | β-catenin | axin | RTPR |
| Mdm2 | p53 | β-catenin | Bcl-9 | RTPR |
| Mdm2 | p53 | β-catenin | TCF-4 | RTPR |
| Mdm2 | p53 | β-catenin | ICAT | RTPR |
| Mdm2 | p53 | β-catenin | LRH-1 | RTPR |
| Mdm2 | p53 | β-catenin | APC | RTPR |
| SCF$^{skp2}$ | p27 | β-catenin | axin | RTPR |
| SCF$^{skp2}$ | p27 | β-catenin | Bcl-9 | RTPR |
| SCF$^{skp2}$ | p27 | β-catenin | TCF-4 | RTPR |
| SCF$^{skp2}$ | p27 | β-catenin | ICAT | RTPR |
| SCF$^{skp2}$ | p27 | β-catenin | LRH-1 | RTPR |
| SCF$^{skp2}$ | p27 | β-catenin | APC | RTPR |
| BTB-CUL3-RBX1 | Nrf2 | β-catenin | Bcl-9 | RTPR |
| BTB-CUL3-RBX1 | SPOP | β-catenin | Bcl-9 | RTPR |
| APC/C | ABBA | β-catenin | Bcl-9 | RTPR |
| APC/C | KEN | β-catenin | Bcl-9 | RTPR |
| APC/C | DBOX | β-catenin | Bcl-9 | RTPR |
| SIAH | PHYL | β-catenin | Bcl-9 | RTPR |
| BTB-CUL3-RBX1 | Nrf2 | β-catenin | axin | RTPR |
| BTB-CUL3-RBX1 | SPOP | β-catenin | axin | RTPR |
| APC/C | ABBA | β-catenin | axin | RTPR |
| APC/C | KEN | β-catenin | axin | RTPR |
| APC/C | DBOX | β-catenin | axin | RTPR |
| SIAH | PHYL | β-catenin | axin | RTPR |
| BTB-CUL3-RBX1 | Nrf2 | β-catenin | TCF-4 | RTPR |
| BTB-CUL3-RBX1 | Nrf2 | β-catenin | APC | RTPR |

TABLE 2

| Target protein and binding partner | Grafting site in scaffold | Amino acid sequence | DNA sequence optimised for E. coli expression |
|---|---|---|---|
| β-catenin | | | |
| axin | helix | GAVPEYILDIHVRVQLEL (SEQ ID NO: 20) | GGTGCATATCCGGAATACATCCTGGATATTCATGTTTATCGTGTTCAGCTGGAACTG (SEQ ID NO: 65) |
| Bcl-9 | helix | SQPQLEHYRSLITLYDIQLML (SEQ ID NO: 21) | AGCCAAGAACAGCTGGAACATCGTTATCGCCTGATTACCCTGTATGATATTCAGCTGATGCTG (SEQ ID NO: 67) |
| TCF-4 | loop | QELGDNDELMHFSYESTQD (SEQ ID NO: 22) | CAAGAACTGGGCGATAATGATGAACTGATGCACTTTAGCTATGAAAGCACCCAGGAT (SEQ ID NO: 69) |
| ICAT | helix | YAYQRAIVEYMLRLMS (SEQ ID NO: 23) | TATGCATATCAGCGTGCCATCGTTGAATATATGCTGCGTCTGATGAGC (SEQ ID NO: 71) |
| LRH-1 | helix | YEQAIAAYLDALMC (SEQ ID NO: 24) | TATGAACAGGCAATTGCAGCATATCTGGATGCACTGATGTGT (SEQ ID NO: 73) |
| APC | loop | SCSEELEALEALELDE (SEQ ID NO: 25) | AGCTGTAGCGAAGAACTGGAAGCCCTGGAAGCATTAGAACTGGATGAA (SEQ ID NO: 75) |
| α-catenin | helix | RSKKAHVLAASVEQATQNFL EKGEQIAKESQ (SEQ ID NO: 1327) | CGCAGCAAAAAAGCCATGTGCTGGCGGCAGCGGTGGAACAGGCGACCCAGAACTTTCTGGAAAAGGCGAACAGA TTGCGAAAGAAAGCCAG (SEQ ID NO: 2136) |
| α-catenin | helix | RTLTVERLLEPLVTQVTTLV (SEQ ID NO: 1328) | CGCACCCTGACCGTGGAACGCCTGCTGGAACCGCTGGTGACCCAGGTGACCACCCTGGTG (SEQ ID NO: 2137) |
| APC Membrane recruitment protein | loop | RREQLEAQEARAREAHAREA HAREAYTREAYGREAYAREA HTWEAHGREARTREAQA (SEQ ID NO: 1329) | CGCCGCGAACAGCTGGAAGCGCAGGAAGCGCGCGCCCGCGAAGCCCATGCGCGCGAA AGCGTATACCCGCGAAGCGTATGGCCGCGAAGCGTATGCCGAAGCGCATACCTGGGAAGCGCATGGCCGCGAA GCGCGCACCCGCGAAGCGCAGGCG (SEQ ID NO: 2138) |
| SOX | loop | D..EFDQYL (SEQ ID NO: 1330) | GATNNNNNNGAATTTGATCAGTATCTG (SEQ ID NO: 2139) |
| kindlin 2 | loop | QALLDKAKINQ GWLDSSRSLMEQDKENEALL RF (SEQ ID NO: 1331) | CAGGCCCTGCTGGATAAAGCGAAAATTAACCAGGGCTGGCTGGATAGCAGCCGCAGCCTGATGGAACAGGATAAAG AAAACGAAGCGCTGCTGCGCTTT (SEQ ID NO: 2140) |
| KRAS | | | |
| SOS1 | helix | FRGIALTNYLKALEG (SEQ ID NO: 1332) | TTTGAAGGTATTGCACTGACCAATTATCTGAAAGCACTGGAAGGT (SEQ ID NO: 2141) |
| phage-display library peptide KR-pep1 | loop | PLYISY (SEQ ID NO: 1333) | CCCCTGTACATCAGCTAC (SEQ ID NO: 2142) |
| Synthetic peptide 225-1 | helix | SIEDLHEYWARLWNYLYVA (SEQ ID NO: 1334) | AGCATTGAAGATCTGCATGAATATTGGGCGCGCCTGTGGAACTATCTGTATGTGGCG (SEQ ID NO: 2143) |
| Synthetic peptide 225-15a | helix | QASLEELHEYWARLWNYRVA (SEQ ID NO: 1335) | CAGGCGAGCCTGGAAGAACTGCATGAATATTGGGCGCGCCTGTGGAACTATCGCGTGGCG (SEQ ID NO: 2144) |
| Synthetic peptide 225-15b | helix | NASIKQLHAYWQRLYAYLAA VA (SEQ ID NO: 1336) | AACGCCAGCATTAAACAGCTGCATGCGTATTGGCAGCGCCTGTATGCGTATCTGGCGGCGGTGGCG (SEQ ID NO: 2145) |
| phage-display library peptide KR-pep3 | loop | CMWWREICPVWW (SEQ ID NO: 1337) | TGCATGTGGTGGCGCGAAATTTGCCCGGTGTGGTGG (SEQ ID NO: 2146) |

TABLE 2-continued

| Target protein and binding partner | Grafting site in scaffold | Amino acid sequence | DNA sequence optimised for E. coli expression |
|---|---|---|---|
| Raf-S | loop | FARKTFLKLAF (SEQ ID NO: 1338) | TTTGCGCGCAAAACCTTTCTGAAACTGGCGTTT (SEQ ID NO: 2147) |
| NF1 | loop | ARRFFLDIAD (SEQ ID NO: 1339) | GCGCGCCGCTTCTTTCTGGATATTGCGGAT (SEQ ID NO: 2148) |
| RasIn peptide 2 | loop | FRMP..RL.. (SEQ ID NO: 1340) | TTTCGCTGGCCGNNNNNNCGCCTGNNNNNN (SEQ ID NO: 2149) |
| RasIn peptide 1 | loop | t.VFXh.p (SEQ ID NO: 1341) | AGCATTGTGTTTGGCGCGCATGAT (SEQ ID NO: 2150) |
| NF1 monobody peptide (74-84) | loop | YGHGQVYYY (SEQ ID NO: 1342) | TATGGCCATGGCCAGGTGTATTATTAT (SEQ ID NO: 2151) |
| farnesyl transferase 1 | loop | ENPKQN (SEQ ID NO: 1343) | GAAAACCCGAAACAGAAC (SEQ ID NO: 2152) |
| farnesyl transferase 2 | loop | DAYECLDASRPW (SEQ ID NO: 1344) | GATGCGTATGAATGCCTGGATGCGAGCCGCCCGTGG (SEQ ID NO: 2153) |
| farnesyl transferase 3 | loop | KSRDFYH (SEQ ID NO: 1345) | AAATCCCGCGATTTCTATCAT (SEQ ID NO: 2154) |
| c-Myc | | | |
| Aurora A | helix | AGVEHQLRREVEIQSH (SEQ ID NO: 1346) | GCGGGGCGTGGAACATCAGCTGCGCCGCGAAGTGGAAATTCAGAGCCAT (SEQ ID NO: 2155) |
| Aurora A | loop | WSVHAPSRRTTpLAGTLDYLPPEMI (SEQ ID NO: 1347) | TGGAGCGTGCATGCGCCGAGCAGCCGCCGCGAACTGGCGGGCACCCTGGATTATCTGCCGCCGGAAATGATT (SEQ ID NO: 2156) |
| Aurora A | helix | TYQETY (SEQ ID NO: 1348) | ACCTATCAGGAAACCTAT (SEQ ID NO: 2157) |
| Omomyc | helix | QAEEQKLSEEDLLRKRREQLKHKLEQLRNSCA (SEQ ID NO: 1349) | CAGGCGGAAGAACAGAAACTGAGCGAAGAAGATCTGCTGCGCAAACGCCGCGAACAGCTGAAACATAAACTGGAACAGCTGCGCAACAGCT (SEQ ID NO: 2158) |
| Myc H1 F8A | loop | NELKRSFAALRDQI (SEQ ID NO: 1350) | AACGAACTGAAACGCAGCTTTGCGGCGCTGCGCGATCAGATT (SEQ ID NO: 2159) |
| Myc H1 F8A S6A | loop | NELKRAFAALRDQI (SEQ ID NO: 1351) | AACGAACTGAAACGCGCGTTTGCGGCGCTGCGCGATCAGATT (SEQ ID NO: 2160) |
| MIP | helix | IREKNHYHRQEVDDLRRQNALLEQQVRAL (SEQ ID NO: 1352) | ATTCGCGAAAAAAACCATTATCATCGCCAGGAAGTGGATGATCTGCGCCGCCAGAACGCGCTGCTGGAACAGCAGGTGCGCGCTG (SEQ ID NO: 2161) |
| PIN1 | loop | FNHITNASQWE (SEQ ID NO: 1353) | TTTAACCATATTACCAACGCGAGCCAGTGGGAA (SEQ ID NO: 2162) |
| PIN2 | loop | GDLGAFSRGQM (SEQ ID NO: 1354) | GGCGATCTGGGCGCGTTTAGCCGCGGCCAGATG (SEQ ID NO: 2163) |
| 9E10 paratrope | loop | RSEFYYGNTYYSAMD (SEQ ID NO: 1355) | CGCAGCGAATTTTATTATTGGCAACACCTATTATTATAGCGCGATGGAT (SEQ ID NO: 2164) |
| BIN1 | loop | QHDYTATDE (SEQ ID NO: 1356) | CAGCATGATTATACCGCGACCGATGAA (SEQ ID NO: 2165) |
| BIN1 | loop | QNPEEQDEGW (SEQ ID NO: 1357) | CAGAACCCGGAAGAACAGGATGAAGGCTGG (SEQ ID NO: 2166) |
| BIN1 | loop | EKCRGVFPENF (SEQ ID NO: 1358) | GAAAAGTGCCGCGGCGTGTTTCCGGAAAACTTT (SEQ ID NO: 2167) |

TABLE 2-continued

| Target protein and binding partner | Grafting site in scaffold | Amino acid sequence | DNA sequence optimised for E. coli expression |
|---|---|---|---|
| BRD4 | | | |
| JMJD6 | loop | KWTLERLKRKYRN (SEQ ID NO: 1522) | AAATGGACCCTGGAACGTCTGAAACGTAAATACCGTAAC (SEQ ID NO: 2303) |
| murine leukemia virus integrase | loop | TWRVQRSQNPLKIRLTR (SEQ ID NO: 1523) | ACCTGGCGTGTTCAGCGTTCTCAGAACCCGCTGAAAATCCGTCTGACCCGT (SEQ ID NO: 2304) |
| EWS-FLJ1 | | | |
| ESAP1 | loop | TMRGKKKRTRAN (SEQ ID NO: 1524) | ACCATGCGCGGCAAAAAAAAACGCACCCGCGAAC (SEQ ID NO: 2305) |
| Aurora A | | | |
| TPX2 | loop | SYSYDAPSDFINFSS (SEQ ID NO: 1525) | AGCTATAGCTATGATGCGCCCAGCGATTTTATTAACTTTAGCAGC (SEQ ID NO: 2306) |
| TPX2 | loop | SYSYDAPSDFINFSSLLDDEGDTQNIDSWF EERKANLEN (SEQ ID NO: 1526) | AGCTATAGCTATGATGCGCCCAGCGATTTTATTAACTTTAGCAGCCTGCTGGATGATGAAGGCGATACCCAGAACATTGATAGCTGGTTTGAAGAA (SEQ ID NO: 2307) |
| TPX3 | loop | MSQVKSSYSYDAPSDFINFSSLLD (SEQ ID NO: 1527) | ATGAGCCAGGTGAAGTCATCTTATTCCTATGATGCCCCCAGCGATTTCATCAATTTTCATCCTTGGATGATGAA (SEQ ID NO: 2308) |
| N-myc | helix | MALSPSRGFAEHSSEPPSWVTTMLYENEL WI (SEQ ID NO: 1528) | ATGGCGCTGAGCCCGAGCCGCGGCTTTGCGGAACATAGCAGCGAACCGCCGAGCTGGGTGACCATTATGCTGTATGAAAACGAACTGTGGATT (SEQ ID NO: 2309) |
| N-myc | loop | LEFDSLQPCFYPDEDFYFGGPDSTPPGE (SEQ ID NO: 1529) | CTGGAATTTGATAGCCTGCAGCCGTGCTTTTATCCGGATGAAGATGATTTTTATTTTGGCGGCCCGGATAGCACCCCGCCGGGCGAA (SEQ ID NO: 2310) |
| CK2alpha | | | |
| CK2beta | loop | RLYGFKIHPMAYQLQ (SEQ ID NO: 1530) | CGCCTGTATGGCTTTAAAATTCATCCGATGGCGTATCAGCTGCAG (SEQ ID NO: 2311) |
| WDRS | | | |
| MLL1 | loop | EPPLNPHGSARAEVHLRKS (SEQ ID NO: 1531) | GAACCGCCGCTGAACCCGCATGGCAGCGCGCGCGAAGTGCATCTGCGCAAAAGC (SEQ ID NO: 2312) |
| Notch | | | |
| MAML1 | helix | SAVMERLRRRIELCRRHHST (SEQ ID NO: 1532) | AGCGCGGTGATGGAACGCCTGCGCCGCCGCATTGAACTGTGCCGCCGCCATCATAGCACC (SEQ ID NO: 2313) |
| Cdk2 | | | |
| cyclin A | helix | TYTKKQVLRMEHLVLKVLTFDL (SEQ ID NO: 1533) | ACCTATACCAAAAAACAGGTGCTGCGCATGAACATCTGGTGCTGAAAGTGCTGACCTTT (SEQ ID NO: 2314) |
| aptmer library | | LVCKSYRLDWEAGALFRSLF (SEQ ID NO: 1534) | CTGGTGTGCAAAAGCTATCGCCTGGATTGGGAAGCGGGCGCGCTGTTTCGCAGCCTGTTT (SEQ ID NO: 2315) |
| aptmer library | | YSFVHHGFFNFRVSWREMLA (SEQ ID NO: 1535) | TATAGCTTTGTGCATCATGGCTTTTTTAACTTTCGCGTGAGCTGGCGCGAAATGCTGGCG (SEQ ID NO: 2316) |
| peptide | loop | TAALS (SEQ ID NO: 1536) | ACCGCGGCGCTGAGC (SEQ ID NO: 2317) |

TABLE 2-continued

| Target protein and binding partner | Grafting site in scaffold | Amino acid sequence | DNA sequence optimised for E. coli expression |
|---|---|---|---|
| peptide | loop | TALLS (SEQ ID NO: 1537) | ACCGCGCTGCTGAGC (SEQ ID NO: 2318) |
| peptide | loop | LAALS (SEQ ID NO: 1538) | CTGGCGGCGCTGAGC (SEQ ID NO: 2319) |
| peptide | loop | DAALT (SEQ ID NO: 1539) | GATGCGGCGCTGACC (SEQ ID NO: 2320) |
| peptide | loop | YAALQ (SEQ ID NO: 1540) | TATGCGGCGCTGCAG (SEQ ID NO: 2321) |
| peptide | loop | SKL.RFTGCSC (SEQ ID NO: 1541) | AGCAAACTGNNNCGCTTTACCGGCTGCAGCTGC (SEQ ID NO: 2322) |
| RXL peptide | loop | PVKRRLFL (SEQ ID NO: 1542) | CCGGTGAAACGCCGCCTGTTTCTG (SEQ ID NO: 2323) |
| p21 | loop | GRKRRQTSMTDFYHSKRRLIFSKRKP (SEQ ID NO: 1543) | GGCCGCAAACGCCGCCAGACCAGCATGACCGATTTTTATCATAGCAAACGCCGCCTGATTTTTAGCAAACGCAAACCG (SEQ ID NO: 2324) |

PLK1

| | | | |
|---|---|---|---|
| peptide | loop | MAGPMQTSpTPKNAGKK (SEQ ID NO: 1544) | ATGGCGGGCCCGATGCAGACCAGCACCCCGAAAAACGCGGGCAAAAAA (SEQ ID NO: 2326) |
| PBIP1 | loop | FDPPLHSpTA (SEQ ID NO: 1545) | TTTGATCCGCCGCTGCATAGCACCGCG (SEQ ID NO: 2327) |
| designed peptide | loop | PLHSpTAI (SEQ ID NO: 1546) | CCGCTGCATAGCACCGCGATT (SEQ ID NO: 2328) |
| designed peptide | loop | MDSpTPL (SEQ ID NO: 1547) | ATGGATAGCACCCCGCTG (SEQ ID NO: 2329) |
| Emi2 | loop | FSQHKpTI (SEQ ID NO: 1548) | TTTAGCCAGCATAAAACCAGCATT (SEQ ID NO: 2330) |
| HEF1 | loop | LHYPSpTTALQE (SEQ ID NO: 1549) | CTGCATTATCCGAGCACCACCGCGCTGCAGGAA (SEQ ID NO: 2331) |
| cdc-25 | loop | LLCSpTPNGL (SEQ ID NO: 1550) | CTGCTGTGTGCAGCACCCCGAACGGCCTG (SEQ ID NO: 2332) |

BCR-ABL

| | | | |
|---|---|---|---|
| optimised substrate peptide | loop | EAIYAAPFAKKK (SEQ ID NO: 1551) | GAAGCGATTTATGCGGCGCCGTTTGCAAAAAAAAAA (SEQ ID NO: 2333) |
| proline-rich peptide | helix | APSYPPPPP (SEQ ID NO: 1552) | GCGCCGAGCTATCCGCCGCCGCCGCCG (SEQ ID NO: 2334) |

PP2A

| | | | |
|---|---|---|---|
| optimised substrate peptide | loop | LQTIQEEE (SEQ ID NO: 1553) | CTGCAGACCATTCAGGAAGAAGAA (SEQ ID NO: 2335) |

TABLE 2-continued

| Target protein and binding partner | Grafting site in scaffold | Amino acid sequence | DNA sequence optimised for *E. coli* expression |
|---|---|---|---|
| PP1c | | | |
| consensus sequence | loop | RV.F | CGCGTGNNNTTT (SEQ ID NO: 2335) |
| consensus sequence | loop | SILK (SEQ ID NO: 1554) | AGCATTCTGAAA (SEQ ID NO: 2336) |
| KNL1 | loop | SRRVSFADTIKVFQT (SEQ ID NO: 1555) | AGCCGCCGCGTGAGCTTTGCCGATACCATTAAAGTGTTTCAGACC (SEQ ID NO: 2337) |
| EED (Embryonic ectoderm development) | | | |
| EZH2 | helix | FSSNRQILERTEILNQEWKQ RRIQPV (SEQ ID NO: 1556) | TTTAGCAGCAACCGCCAGATTCTGGAACGCACCGAAATTCTGAACCAGGAATGGAAACAGCGCCGCATTCAGC CGGTG (SEQ ID NO: 2338) |
| MCL-1 | | | |
| EZH2 | helix | KALETLRRVGDGVQRNHETAF (SEQ ID NO: 1557) | AAAGCGCTGGAAACCCTGCGCCGCGTGGGCGATGGCGTGCAGCGCAACCATGAAACCGCGTTT (SEQ ID NO: 2339) |
| NOXA BH3 | helix | AELEVESATQLRRFGDKLNFRQKLL (SEQ ID NO: 1558) | GCGGAACTGGAAGTGGAAAGCGCGACCCAGCTGCGCCGCTTTGGCGATAAACTGAACTTTCGCCAGAAA CTGCTG (SEQ ID NO: 2340) |
| MCL-1 BH3 | helix | KALETLR.VGD.VQRNHETAF (SEQ ID NO: 1559) | AAAGCGCTGGAAACCCTGCGCNNNGTGGGCGATNNNGTGCAGCGCAACCATGAAACCGCGTTT (SEQ ID NO: 2341) |
| GSK3 | | | |
| Substrate-competitive binding peptide | loop | KEAPPAPPQDP (SEQ ID NO: 1723) | AAAGAAGCGCCGCCGGCGCCGCCGCAGGATCCG (SEQ ID NO: 2477) |
| Substrate-competitive binding peptide | loop | LSRRPDYR (SEQ ID NO: 1724) | CTGAGCCGCCGCCCGGATTATCGC (SEQ ID NO: 2478) |
| Substrate-competitive binding peptide | loop | RREGGMSRPADVDG (SEQ ID NO: 1725) | CGCCGCGAAGGCGGCATGAGCCGCCCGGCCGATGTGGATGGC (SEQ ID NO: 2479) |
| Substrate-competitive binding peptide | loop | YRRAAVPPSPSLSRHSSPSQDEDEEE (SEQ ID NO: 1726) | TATCGCCGCGCGGCGGTGCCGCCGAGCCCGAGCCTGAGCCGCCATAGCAGCCCGAGCCAGGAT GAAGATGAAGAAGAA (SEQ ID NO: 2480) |
| CtBP | | | |
| From cyclic peptide library | loop | SGWTVVRMY (SEQ ID NO: 1890) | AGCGGCTGGACCGTGGTGCGCATGTAT (SEQ ID NO: 2616) |
| tankyrase | | | |
| consensus substrate peptide | loop | REAGDGEE (SEQ ID NO: 1891) | CGTGAAGCCGGTGATGGTGAAGAA (SEQ ID NO: 2617) |

TABLE 2-continued

| Target protein and binding partner | Grafting site in scaffold | Amino acid sequence | DNA sequence optimised for E. coli expression |
|---|---|---|---|
| consensus substrate peptide | loop | HLQREAGDEEFRS (SEQ ID NO: 1892) | CATCTCCAGCTGCGTGAAGCCGGTGATGTGAAGAATTTCGTAGC (SEQ ID NO: 2618) |
| Bcl-2 and BCL-XL | | | |
| Bim BH3 | helix | IWIAQELRRIGDEFNAYYARR (SEQ ID NO: 2056) | ATTTGGATTGCGCAGGAACTGCGCCGCATTGGCGATGAATTAACCGCTATTATGCGCCGC (SEQ ID NO: 2754) |
| Bak BH3 | helix | GQVGRQLAIIGDDINR (SEQ ID NO: 2057) | GGCCAGGTGGGCCGCCAGCTGGCGATTATTGGCGATGATATTAACCGC (SEQ ID NO: 2755) |
| Bad BH3 | helix | NLWAAQRYGRELRRMSDEFVDSFKK (SEQ ID NO: 2058) | AACCTGTGGGCGGCGCAGCGCTATGGCCGCGAACTGCGCCGCATGAGCGATGAATTTGTGGATAGCTTTAAAAAA (SEQ ID NO: 2756) |
| Jun library-selected peptide | helix | SIAATLKEEANLEKMNKKLAAEIESLLKEK DKLESVLNYHE (SEQ ID NO: 2059) | AGCATCGCCGCCACCCTGAAGGAGGAGGCCAACCTGGAGAAGATGAACAAGAAGCTGGCCGCCGAGATCGAGAG CCTGCTGAAGGAGAAGGACAAGCTGGAGAGCGTGCTGAACTACCACGAG (SEQ ID NO: 2757) |
| library-selected peptide | helix | VQEIEQEIEKRIKQIQQEFQEIEQQIALL (SEQ ID NO: 2060) | GTTCAGGAAATCGAACAGGAAATCGAAAAACGTATCAAACAGATCCAGCAGGAATTCCAGGAAATC GAACAGCAGATCGCGCT (SEQ ID NO: 2758) |
| BFL1 | | | |
| NOXA BH3 | helix | ATQLRRFGDKLNFRQ (SEQ ID NO: 2061) | GCGACCCAGCTGCGCCGCTTTGGCGATAAACTGAACTTTCGCCAG (SEQ ID NO: 2759) |
| BAX | | | |
| Bcl-2 BH3 | helix and loop | EIVAKYIHYKLSQRGYEWDA (SEQ ID NO: 2062) | GAAATTGTGGCGAAATATATTCATTATAAACTGAGCCAGCGCGGCTATGAATGGGATGCG (SEQ ID NO: 2760) |
| eIF4E | | | |
| eIF4G | helix | KKRYDREFLLGFQF (SEQ ID NO: 2063) | AAAAAACGCTATGATCGCGAATTTCTGCTGGGCTTTCAGTTT (SEQ ID NO: 2761) |
| eIF4G | helix and loop | GKKRYDREFLLGFQFIFASMQKPEGLPHIS DVVL (SEQ ID NO: 2064) | GGCAAAAAACGCTATGATCGCGAATTTCTGCTGGGCTTTCAGTTTATTTTTGCGAGCATGCAGAAACCGGAAGGCCTG CCGCATATTAGCGATG TGGTGCTG (SEQ ID NO: 2762) |
| optimised peptide | helix and loop | TKLIYERAFMKNLRGSPLSQTPPSNVPSCL LRGT (SEQ ID NO: 2065) | ACCAAACTGATTTATGAACGCGCGTTTATGAAAAACCTGCGCGGCAGCCCCCTGAGCCAGCCAGACCCCGC CGAGCAACGTGCCGAGCTGCCTGCTG CGCGGCACC (SEQ ID NO: 2763) |
| Fos | | | |
| library-selected peptide | helix | AIARLEERVKTLKAEIYELRSKANMLREQIAQ LGAP (SEQ ID NO: 2066) | GCGATTGCGCGCCTGGAAGAACGCGTGAAAACCCTGAAAGCGGAAATTTATGAACTGCGCAGCAAAGC CGCGAACATGCTGCGCGAACAGATTGC (SEQ ID NO: 2764) |

TABLE 2-continued

| Target protein and binding partner | Grafting site in scaffold | Amino acid sequence | DNA sequence optimised for *E. coli* expression |
|---|---|---|---|
| library-selected peptide HDAC4 | helix | AIARLEERVKTLKAEIYELQSEANMLREQIAQ LGAP (SEQ ID NO: 2067) | GCGATTGCGCGCCTGGAAGAACGCGTGAAGAACCCTGAAAGCGGAAATTATGAACTGCGCAGCAAAGC GAACATGCTGCGCGAACATGCTGTTGC (SEQ ID NO: 2756) |
| SMRT corepressor BCL6 | loop | HIRGSITQGIPRSYV (SEQ ID NO: 2068) | CACACATCCGTGTTCTATCACCCAGGGTATCCGCGTTCTTACGTT (SEQ ID NO: 2766) |
| SMRT and N-CoR corepressors | loop | GRSIHEIPR (SEQ ID NO: 2069) | GGCCCGCAGCATTCATGAAATTCCGCGC (SEQ ID NO: 2767) |
| SMRT and N-CoR corepressors Tau | loop | GIVATVKEAGRSIHEIPREEL (SEQ ID NO: 2070) | GGCCTGGTGGCGACCGTGAAAGAAGCGGGCCGCAGCATTCATGAAATTCCGCGCGAAGAACTG (SEQ ID NO: 2768) |
| alpha-tubulin | loop | KDYEEVGVDSVE (SEQ ID NO: 2071) | AAAGATTATGAAGAAGTGGGCGTGGATAGCGTGGAA (SEQ ID NO: 2769) |
| beta-tubulin PD-L1 | loop | YQQYQDATADEQG (SEQ ID NO: 2072) | TATCAGCAGTATCAGGATGCCACCGCGGATGAACAGGGC (SEQ ID NO: 2770) |
| HIP1R KDM4A | loop | DAVRRIEDMMNQARHASSGV (SEQ ID NO: 2073) | GATGCGGTGCGCCGCATTGAAGATATGATGAACCAGGCGCGCCATGCGAGCAGCGGCGTG (SEQ ID NO: 2771) |
| library-selected peptide EGFR | loop | YVNTRSGWRWYT (SEQ ID NO: 2074) | TACGTTTACACACCCGTTCTGGTTGGCGTTGGTACACC (SEQ ID NO: 2772) |
| EGFR (juxtamembrane coiled-coil domain) RA825 | helix | VRKRTLRLLQERELVE (SEQ ID NO: 2075) | GTGCGCAAACGCACCCTGCGCCGCCTGCTGCAGGAACGCGAACTGTGTGAA (SEQ ID NO: 2773) |
| RFIP1 | helix | RQVRELENVIDRLVRVMEETPNILRIPR (SEQ ID NO: 2076) | CGCCAGGTGCGCGAACTGGAAAACATATATTGATCGCCTGGTGCGCGTGATGGAAGAAACCCCGAACATTCTGCG CATTCCGCGC (SEQ ID NO: 2774) |
| GPCRs and other transmembrane proteins | | | |
| PAR1 pepducin | N-term | pal-KKSRALF-NH2 (pal-= palmitoyl; -NH2 = amino group) (SEQ ID NO: 2077) | synthetic peptide |
| PAR1 pepducin | N-term | pal-RCLSSSAVANRS-NH2 (SEQ ID NO: 2078) | synthetic peptide |

TABLE 2-continued

| Target protein and binding partner | Grafting site in scaffold | Amino acid sequence | DNA sequence optimised for E. coli expression |
|---|---|---|---|
| PAR1 pepducin | N-term | pal-RSLSSSAVANRS-NH2 (SEQ ID NO: 2079) | synthetic peptide |
| PAR1 pepducin | N-term | pal-AVANRSKKSRALF-NH2 (SEQ ID NO: 2080) | synthetic peptide |
| PAR1 pepducin | N-term | pal-RCESSSAEANRSKKERELF-NH2 (SEQ ID NO: 2081) | synthetic peptide |
| PAR1 pepducin | N-term | pal-ASSESQRYVYSIL-NH2 (SEQ ID NO: 2082) | synthetic peptide |
| PAR1 pepducin | N-term | pal-ASSASQEVYYSIL-NH2 (SEQ ID NO: 2083) | synthetic peptide |
| PAR2 pepducin | N-term | pal-RSSAMDENSEKKRKSAIK-NH2 (SEQ ID NO: 2084) | synthetic peptide |
| PAR2 pepducin | N-term | pal-GDENSEKKRKQAIK-NH2 (SEQ ID NO: 2085) | synthetic peptide |
| PAR2 pepducin | N-term | pal-SGRRYGHALR-NH2 (SEQ ID NO: 2086) | synthetic peptide |
| PAR4 pepducin | N-term | pal-ATGAPRLPST-NH2 (SEQ ID NO: 2087) | synthetic peptide |
| PAR4 pepducin | N-term | pal-RLAHGYRRGS-NH2 (SEQ ID NO: 2088) | synthetic peptide |
| PAR4 pepducin | N-term | pal-RTLFKAHMGQKHR-NH2 (SEQ ID NO: 2089) | synthetic peptide |
| CXCR1/2 pepducin | N-term | pal-LCA-YSRVGRSVTD-NH2 (LCA-= lithocholic acid) (SEQ ID NO: 2090) | synthetic peptide |
| CXCR1/2 pepducin | N-term | pal-HSKGHQKRKALK-NH2 (SEQ ID NO: 2091) | synthetic peptide |
| CXCR4 pepducin | N-term | pal-MGYQKKLRSMTD-NH2 (SEQ ID NO: 2092) | synthetic peptide |
| CXCR4 pepducin | N-term | pal-MGYQKKLRSMTDKYRL-NH2 (SEQ ID NO: 2093) | synthetic peptide |
| S1P3 pepducin | N-term | myristoyl-GMRPYDANKR-NH2 (SEQ ID NO: 2094) | synthetic peptide |

TABLE 2-continued

| Target protein and binding partner | Grafting site in scaffold | Amino acid sequence | DNA sequence optimised for *E. coli* expression |
|---|---|---|---|
| S1P3 pepducin | N-term | myristoyl-GRPYDAN-NH2 (SEQ ID NO: 2095) | synthetic peptide |
| FRP2 pepducin | N-term | pal-KIHKKGMIKSSRPLRV-NH2 (SEQ ID NO: 2096) | synthetic peptide |
| FRP2 pepducin | N-term | pal-KIHKKGMIKS-NH2 (SEQ ID NO: 2097) | synthetic peptide |
| FRP2 pepducin | N-term | pal-KIHKKGMIKSSR-NH2 (SEQ ID NO: 2098) | synthetic peptide |
| LGR7 pepducin | N-term | pal-KRKALKALILNEKKVQ-H (—H = hydrogen) (SEQ ID NO: 2099) | synthetic peptide |
| SMO pepducin | N-term | pal-TFVADWRNSNRY-H (SEQ ID NO: 2100) | synthetic peptide |
| SMO pepducin | N-term | pal-TWAWHTSFKALGTTYQPLSG KTS-H (SEQ ID NO: 2101) | synthetic peptide |
| SMO pepducin | N-term | pal-RGVMTLFSIKSNHPGLLSEKAASKINETMLR-H (SEQ ID NO: 2102) | synthetic peptide |
| IGF1R pepducin | N-term | pal-RNNSRLGNGVLY-NH2 (SEQ ID NO: 2103) | synthetic peptide |
| CD226 pepducin | N-term | pal-RRERRDLFTE-NH2 (SEQ ID NO: 2104) | synthetic peptide |
| TRPV1 TRPducin | N-term | pal-MGETVNKIAQES-NH2 (SEQ ID NO: 2105) | synthetic peptide |
| Nrp1/2 | | | |
| paratrope | loop | RASQYFSSYLA (SEQ ID NO: 2106) | CGCGCGAGCCAGTATTTTAGCAGCTATCTGGCG (SEQ ID NO: 2775) |
| paratrope | helix | AREDFRNRRLWYVMDY (SEQ ID NO: 2107) | GCGCGCGAAGATTTTCGCAACCGCCGCCTGTGGTATGTGATGGATTAT (SEQ ID NO: 2776) |

TABLE 2-continued

| Target protein and binding partner | Grafting site in scaffold | Amino acid sequence | DNA sequence optimised for *E. coli* expression |
|---|---|---|---|
| IL18 | | | |
| paratrope | helix | KASGYSFTDYFIY (SEQ ID NO: 2108) | AAAGCGAGCGGCTATAGCTTTACCGATTATTTATTAT (SEQ ID NO: 2777) |
| paratrope | loop | YRDRRRPS (SEQ ID NO: 2109) | TATCGCGATCGCCGCCGCCCGAGC (SEQ ID NO: 2778) |
| IL15 | | | |
| Thyroid stimulating hormone receptor | | | |
| paratrope | loop | SGSSSDIGSNYVS (SEQ ID NO: 2110) | AGCGGCAGCAGCAGCGATATTGGCAGCAACTATGTGAGC (SEQ ID NO: 2779) |
| EGF receptor | | | |
| paratrope | loop | QQWSSHIFT (SEQ ID NO: 2111) | CAGCAGTGGAGCAGCCATATTTTTACC (SEQ ID NO: 2780) |
| paratrope | helix | ASRDYDYAGRYFDY (SEQ ID NO: 2112) | GCGAGCCGCGATTATGATTATGCGGGCCGCTATTTTGATTAT (SEQ ID NO: 2781) |
| IL23 | | | |
| paratrope | loop | QNGHSFPFT (SEQ ID NO: 2113) | CAGAACGGCCATAGCTTTCCGTTTACC (SEQ ID NO: 2782) |
| paratrope | helix | YINPYNDGTK (SEQ ID NO: 2114) | TATATTAACCCGTATAACGATGGCACCAAA (SEQ ID NO: 2783) |
| paratrope | helix | ARNWDVAY (SEQ ID NO: 2115) | GCGCGCAACTGGGATGTGGCGTAT (SEQ ID NO: 2784) |
| Lymphocyte function associated antigen 1 (LFA-1) | | | |
| paratrope | helix | SGYSFTGHWMN (SEQ ID NO: 2116) | AGCGGCTATAGCTTTACCGGCCATTGGATGAAC (SEQ ID NO: 2785) |
| paratrope | helix | MIHPSDSETR (SEQ ID NO: 2117) | ATGATTCATCCGAGCGATAGCGAAACCCGC (SEQ ID NO: 2786) |
| paratrope | helix | ARGIYFYGTTYFDY (SEQ ID NO: 2118) | GCGCGCGGCATTTATTTTTATGGCACCACCTATTTTGATTAT (SEQ ID NO: 2787) |
| C3b | | | |
| paratrope | helix | SGFSFTSVS (SEQ ID NO: 2119) | AGCGGCTTTAGCTTTACCAGCGTGAGC (SEQ ID NO: 2788) |
| paratrope | helix | LIYPYNGFN (SEQ ID NO: 2120) | CTGATTTATCCGTATAACGGCTTTAAC (SEQ ID NO: 2789) |
| FGF receptor 3 | | | |
| paratrope | helix | AASGFTFTSTGIS (SEQ ID NO: 2121) | GCGGCGAGCGGCTTTACCTTTACCAGCACCGGCATTAGC (SEQ ID NO: 2790) |
| paratrope | helix | ARTYGIYDLYVDYTE (SEQ ID NO: 2122) | GCGCGCACCTATGGCATTTATGATCTGTATGTGGATTATACCGAA (SEQ ID NO: 2791) |
| IL2 | | | |

TABLE 2-continued

| Target protein and binding partner | Grafting site in scaffold | Amino acid sequence | DNA sequence optimised for E. coli expression |
|---|---|---|---|
| paratrope | helix | SRDYGYYFD (SEQ ID NO: 2123) | AGCCGCGATTATGGCTATTATTTTGAT (SEQ ID NO: 2792) |
| paratrope | helix | GYSFTRYWMH (SEQ ID NO: 2124) | GGCTATAGCTTTACCCGCTATTGGATGCAT (SEQ ID NO: 2793) |
| HER2 | | | |
| paratrope | loop | QWWWPST (SEQ ID NO: 2125) | CAGTGGTGGTGTGGCCGAGCACC (SEQ ID NO: 2794) |
| paratrope | helix | ASGFSIWWSWIH (SEQ ID NO: 2126) | GCGAGCGGCTTTAGCATTTGGTGGAGCTGGATTCAT (SEQ ID NO: 2795) |
| membrane-type serine protease 1 | | | |
| paratrope | loop | YDNNQRPS (SEQ ID NO: 2127) | TATGATAACAACCAGCGCCCGAGC (SEQ ID NO: 2796) |
| paratrope | helix | TFHIRRYRSGYYDKMDH (SEQ ID NO: 2128) | ACCTTTCATATTCGCCGCTATCGCAGCGGCTATTATGATAAAATGGATCAT (SEQ ID NO: 2797) |
| beta-secretase | | | |
| paratrope | helix | ARGPFSPWVMDY (SEQ ID NO: 2129) | GCGCGCGGCCCGTTTAGCCCGTGGGTGATGGATTAT (SEQ ID NO: 2798) |
| VEGF-R | | | |
| paratrope | helix | TRHDGTNFD (SEQ ID NO: 2130) | ACCCGCCATGATGGCACCAACTTTGAT (SEQ ID NO: 2799) |
| paratrope | helix | QQAKAFPPT (SEQ ID NO: 2131) | CAGCAGGCGAAAGCGTTTCCGCCGACC (SEQ ID NO: 2800) |
| lrp5/6 receptor | | | |
| paratrope | helix | SGHVNAVKNYGY (SEQ ID NO: 2132) | AGCGGCCATGTGAACGCGGTGAAAAACTATGGCTAT (SEQ ID NO: 2801) |
| hepsin protease | | | |
| paratrope | helix | WINTETGS (SEQ ID NO: 2133) | TGGATTAACACCGAAACCGGCAGC (SEQ ID NO: 2802) |
| Factor D | | | |
| paratrope | helix | WINTYTGE (SEQ ID NO: 2134) | TGGATTAACACCTATACCGGCGAA (SEQ ID NO: 2803) |
| paratrope | helix | GYTFTNYGMN (SEQ ID NO: 2135) | GGCTATACCTTTACCAACTATGGCATGAAC (SEQ ID NO: 2804) |

TABLE 3

| Ubiquitin Ligase | Degron sequence derived from | Grafting site in scaffold | Amino acid sequence | DNA sequence E. Coli codon optimised 5' to 3' |
|---|---|---|---|---|
| Mdm2 | Consensus | helix | F[\/P]{3}W[\/P]{2,3}[VIL] | TTT[NNNNNNNN(EXCEPT CCN)]TGG[NNN{2,3}(\/CCN)][GTG/ATT/CTG] (SEQ ID NO: 2945) |
| Mdm2 | p53 | helix | FAAYWNLLSAYG (SEQ ID NO: 2805) | TTTGCAGCCTATTGGAATCTGCTGAGCGCATATGGT (SEQ ID NO: 2946) |
| Mdm2 | p53 | helix | RFMDYWEGL (SEQ ID NO: 2806) | CGCTTCATGGATTATTGGGAAGGTCTG (SEQ ID NO: 2947) |
| Mdm2 | p53 | helix | TSFAEYWALLAENL (SEQ ID NO: 2807) | ACCAGCTTTGCCGAGTATTGGGCCCTGCTGGCCGAGAATCTG (SEQ ID NO: 2948) |
| Mdm2 | p53 | helix | EAQWAAL (SEQ ID NO: 2808) | GAAGCGCAGTGGGCGGCGCTG (SEQ ID NO: 2949) |
| Mdm2 | p53 | helix | FEAQWAAL (SEQ ID NO: 2809) | TTTGAAGCGCAGTGGGCGGCGCTG (SEQ ID NO: 2950) |
| Mdm2 | p63 | helix | FQHIWDFL (SEQ ID NO: 2810) | TTTCAGCATATTTGGGATTTTCTG (SEQ ID NO: 2951) |
| Mdm2 | p73 | helix | FEHLWSSL (SEQ ID NO: 2811) | TTTGAACATCTGTGGAGCAGCCTG (SEQ ID NO: 2952) |
| SCF(Skp2) | Consensus | loop | .[DE].pTP.K | NNN[GAT/GAA]NNNACCCCGNNNAAA (SEQ ID NO: 2953) |
| SCF(Skp2) | p27 | loop | AGSNEQEPKKRS (SEQ ID NO: 2812) | GCAGGTAGCAATGAACAAGAACCGAAAAAACGTAGT (SEQ ID NO: 2954) |
| Cul3-Keap1 | Consensus | loop | [DNS].[DES][TNS] GE | [GAC/AAC/AGC]NNN[GAC/GAA/AGC][ACC/AAC/AGC]GGCGAA (SEQ ID NO: 2955) |
| Cul3-Keap1 | Nrf2 | loop | DPETGEL (SEQ ID NO: 2813) | GATCCGGAAACCGGTGAACTG (SEQ ID NO: 2956) |
| Cul3-Keap1 | Sequestosome-1 | loop | DPSTGEL (SEQ ID NO: 2814) | GATCCGAGCACCGGCGAACTG (SEQ ID NO: 2957) |
| Cul3-Keap1 | IKKB | loop | NQETGE (SEQ ID NO: 2815) | AACCAGGAAACCGGCGAA (SEQ ID NO: 2958) |
| Cul3-KEAP1 | APC membrane recruitment protein 1 | loop | SPETGE (SEQ ID NO: 2816) | AGCCCGGAAACCGGCGAA (SEQ ID NO: 2959) |
| Cul3-KEAP1 | Prothymosin alpha | loop | NEENGE (SEQ ID NO: 2817) | AACGAAGAAAACGGCGAA (SEQ ID NO: 2960) |
| Cul3-KEAP1 | Nucleosome-remodeling factor subunit BPTF | oop | DPENGE (SEQ ID NO: 2818) | GATCCGGAAAACGGCGAA (SEQ ID NO: 2961) |
| Cul3-KEAP1 | Serine/threonine-protein phosphatase PGAM5, mitochondrial | loop | NVESGE (SEQ ID NO: 2819) | AACGTGGAAAGCGGCGAA (SEQ ID NO: 2962) |
| Cul3-KEAP1 | Nuclear factor erythroid 2-related factor 2 | loop | DEETGE (SEQ ID NO: 2820) | GATGAAGAAACCGGCGAA (SEQ ID NO: 2963) |
| Cul3-KEAP1 | Partner and localizer of BRAC2 | loop | DEETGE (SEQ ID NO: 2821) | GATGAAGAAACCGGCGAA (SEQ ID NO: 2964) |

TABLE 3-continued

| | | | | |
|---|---|---|---|---|
| Cul3-KEAP1_2 | Consensus | loop | QD.DLGV<br>(SEQ ID NO: 2822) | CAGGATNNNGATCTGGGTGTG<br>(SEQ ID NO: 2965) |
| Cul3-SPOP | Consensus | loop | [AVP].[ST][ST][ST] | [GCG/GTG/CCG]NNN[AGC/ACC][AGC/ACC]<br>[AGC/ACC] |
| Cul3-SPOP | Map kinase<br>phosphatase | loop | ELDSPSSTSSSS<br>(SEQ ID NO: 2823) | GAACTGGATAGCCCGAGCAGCACCAGCAGCAGC<br>(SEQ ID NO: 2966) |
| Cul3-SPOP | SBC | loop | LACDEVTSTTSSSTA<br>(SEQ ID NO: 2824) | CTGGCATGTGATGAAGTTACCAGCACCACCAGTAGC<br>AGCACCGCA<br>(SEQ ID NO: 2967) |
| Cul3-SPOP | Androgen<br>receptor | loop | ASSTT<br>(SEQ ID NO: 2825) | GCGAGCAGCACCACC<br>(SEQ ID NO: 2968) |
| Cul3-SPOP | Map kinase<br>phosphatase | loop | DEVTSTTSSST<br>(SEQ ID NO: 2826) | GATGAAGTGACCAGCACCACCAGCAGCAGCACC<br>(SEQ ID NO: 2969) |
| Cul3-KELCH | Consensus | loop | E.EE.E[AV]DQH<br>(SEQ ID NO: 2827) | GAANNNGAAGAANNNGAA[GCG/GTG]GATAACCAT<br>(SEQ ID NO: 2970) |
| Cul3-KELCH | Serine/<br>threonine-<br>protein<br>kinase WNK1 | helix/loop | EPEEPEADQH<br>(SEQ ID NO: 2828) | GAACCGGAAGAACCGGAAGCGGATCAGCAT<br>(SEQ ID NO: 2971) |
| Cul3-KELCH | Serine/<br>threonine-<br>protein<br>kinase WNK3 | helix/loop | ECEETEVDQH<br>(SEQ ID NO: 2829) | GAATGCGAAGAAACCGAAGTGGATCAGCAT<br>(SEQ ID NO: 2972) |
| Cul3-KELCH | Serine/<br>threonine-<br>protein<br>kinase WNK4 | helix/loop | EPEEPEADQH<br>(SEQ ID NO: 2830) | GAACCGGAAGAACCGGAAGCGGATCAGCAT<br>(SEQ ID NO: 2973) |
| Cul3-KELCH | Nuclear<br>factor<br>erythroid<br>2-related<br>factor 2 | helix/loop | ILWRQDIDLGV<br>(SEQ ID NO: 2831) | ATTCTGTGGCGCCAGGATATTGATCTGGGCGTG<br>(SEQ ID NO: 2974) |
| KELCH<br>actinfilin | Consensus | loop | [AP]P[MV][IM]V | [GCG/CCG]CCG[ATG/GTG][ATT/ATG]GTG<br>(SEQ ID NO: 3099) |
| APC/C | ABBA | loop | [FIVL].[ILMVP][FHY].<br>[DE].{0,3}{DEST} | [TTT/ATT/GTG/CTG]NNN[ATT/CTG/ATG/<br>GTG/CCG][TTT/CAT/TAT][NNN{0,3}]<br>[GAT/GAA/AGC/ACC] |
| APC/C | ABBA | loop | SLSSAFHVFEDGNKEN<br>(SEQ ID NO: 2832) | AGCCTGAGCAGCGCGTTTCATGTGTTTGAAGATGGC<br>AACAAAGAAAAC<br>(SEQ ID NO: 2975) |
| APC/C | Cyclin-A2:<br>ABBA | loop | FTIHVD<br>(SEQ ID NO: 2833) | TTTACCATTCATGTGGAT<br>(SEQ ID NO: 2976) |
| APC/C | ABOX | loop | QRVL | CAGCGTGTTCTG<br>(SEQ ID NO: 2977) |
| APC/C | Consensus | loop | .KEN. | NNNAAAGAAAACNNN<br>(SEQ ID NO: 2834) | (SEQ ID NO: 2978) |
| APC/C | KEN | loop | SEDKENVPP<br>(SEQ ID NO: 2835) | AGCGAGGATAAAGAAAATGTTCCGCCT<br>(SEQ ID NO: 2979) |
| APC/C | DBOX consensus | loop | .R..L..[LIVM]. | NNNCGTNNNNNNNCTGNNNNNNN[CTG/ATT/GTG/<br>ATG]NNN<br>(SEQ ID NO: 2980) |
| APC/C | Shugoshin 1:<br>DBOX | loop | RLSLSPKKN<br>(SEQ ID NO: 2836) | CGCCTGAGCCTGAGCCCGAAAAAAAAC<br>(SEQ ID NO: 2981) |
| APC/C | Shugoshin 1:<br>DBOX | loop | RSSLKKHCN<br>(SEQ ID NO: 2837) | CGCAGCAGCCTGAAAAAACATTGCAAC<br>(SEQ ID NO: 2982) |
| APC/C | Shugoshin 1:<br>DBOX | loop | HLSLKDITN<br>(SEQ ID NO: 2838) | CATCTGAGCCTGAAAGATATTACCAAC<br>(SEQ ID NO: 2983) |

TABLE 3-continued

| APC/C | Bcl-2-like protein 11: DBOX | loop | RSPLFIF (SEQ ID NO: 2839) | CGCAGCCCGCTGTTTATTTTT (SEQ ID NO: 2984) |
|---|---|---|---|---|
| APC/C | Bcl-2-like protein 11: DBOX | loop | RSSLLSR (SEQ ID NO: 2840) | CGCAGCAGCCTGCTGAGCCGC (SEQ ID NO: 2985) |
| APC/C | Securin: DBOX | loop | RKALGTV (SEQ ID NO: 2841) | CGCAAAGCGCTGGGCACCGTG (SEQ ID NO: 2986) |
| APC/C | Securin-2: DBOX | loop | RKALGTV (SEQ ID NO: 2842) | CGCAAAGCGCTGGGCACCGTG (SEQ ID NO: 2987) |
| APC/C | Ski-like protein: DBOX | loop | RLCLPQV (SEQ ID NO: 2843) | CGCCTGTGCCTGCCGCAGGTG (SEQ ID NO: 2988) |
| APC/C | Aurora kinase B: DBOX | loop | RLPLAQV (SEQ ID NO: 2844) | CGCCTGCCGCTGGCGCAGGTG (SEQ ID NO: 2989) |
| APC/C | Serine/threonine-protein kinase PLK1: DBOX | loop | NRKPLTVLN (SEQ ID NO: 2845) | AACAGGAAGCCCCTGACCGTGCTGAAC (SEQ ID NO: 2990) |
| APC/C | Cyclin-A2: DBOX | loop | RAALAVL (SEQ ID NO: 2846) | CGCGCGGCGCTGGCGGTGCTG (SEQ ID NO: 2991) |
| APC/C | G2/mitotic-specific cyclin-B1: DBOX | loop | PRTALGDIG (SEQ ID NO: 2847) | CCGCGCACCGCGCTGGGCGATATTGGC (SEQ ID NO: 2992) |
| APC/C | G2/mitotic-specific cyclin-B3: DBOX | loop | RSAFEDLTN (SEQ ID NO: 2848) | CGCAGCGCGTTTGAAGATCTGACCAAC (SEQ ID NO: 2993) |
| APC/C | S-phase kinase-associated protein 2: DBOX | loop | HRKHLQEIP (SEQ ID NO: 2849) | CATCGCAAACATCTGCAGGAAATTCCG (SEQ ID NO: 2994) |
| APC/C | Nuclear autoantigen Sp-100: DBOX | loop | RSGLQLS (SEQ ID NO: 2850) | CGCAGCGGCCTGCAGCTGAGC (SEQ ID NO: 2995) |
| APC/C | Nucleolar and spindle-associated protien 1: DBOX | loop | RRGLILA (SEQ ID NO: 2851) | CGCCGCGGCCTGATTCTGGCG (SEQ ID NO: 2996) |
| APC/C | BRCA1-A complex subunit RAP80: DBOX | loop | RHCLPTL (SEQ ID NO: 2852) | CGCCATTGCCTGCCGACCCTG (SEQ ID NO: 2997) |
| APC/C | BARD1: DBOX | loop | RNLLHDN (SEQ ID NO: 2853) | CGCAACCTGCTGCATGATAAC (SEQ ID NO: 2998) |
| APC/C | BARD1: DBOX | loop | RAALDRL (SEQ ID NO: 2854) | CGCGCGGCGCTGGATCGCCTG (SEQ ID NO: 2999) |
| APC/C | E3 ubiquitin ligase RNF157: DBOX | loop | RKKL (SEQ ID NO: 2855) | CGCAAAAAACTG (SEQ ID NO: 3000) |
| APC/C | E3 ubiquitin ligase RNF157: DBOX | loop | RRRL (SEQ ID NO: 2856) | CGCCGCCGCCTG (SEQ ID NO: 3001) |
| APC/C | Nuclear-interacting partner of ALK: DBOX | loop | RARLCSS (SEQ ID NO: 2857) | CGCGCGCGCCTGTGCAGCAGC (SEQ ID NO: 3002) |

TABLE 3-continued

| | | | | |
|---|---|---|---|---|
| APC/C | Nuclear-interacting partner of ALK: DBOX | loop | RLPLVPE (SEQ ID NO: 2858) | CGCCTGCCGCTGGTGCCGGAA (SEQ ID NO: 3003) |
| APC/C | Tribbles homolog 3: DBOX | loop | RKKLVLE (SEQ ID NO: 2859) | CGCAAAAAACTGGTGCTGGAA (SEQ ID NO: 3004) |
| APC/C | Anillin: DBOX | loop | RENLQRK (SEQ ID NO: 2860) | CGCGAAAACCTGCAGCGCAAA (SEQ ID NO: 3005) |
| APC/C | Anillin: DBOX | loop | RQPLSEA (SEQ ID NO: 2861) | CGCCAGCCGCTGAGCGAAGCG (SEQ ID NO: 3006) |
| APC/C | Ninein-like protein: DBOX | loop | RTQLETK (SEQ ID NO: 2862) | CGCACCCAGCTGGAAACCAAA (SEQ ID NO: 3007) |
| APC/C | Dual specificity protein kinase TTK: DBOX | loop | RNSLRQT (SEQ ID NO: 2863) | CGCAACAGCCTGCGCCAGACC (SEQ ID NO: 3008) |
| APC/C | Inactive serine/threonine-protein kinase TEX14: DBOX | loop | RYGLHPD (SEQ ID NO: 2864) | CGCTATGGCCTGCATCCGGAT (SEQ ID NO: 3009) |
| APC/C | DBOX | loop | PRLPLGDVSNN (SEQ ID NO: 2865) | CCGCGTCTGCCGCTGGGTGATGTTAGCAATAAT (SEQ ID NO: 3010) |
| APC/C | Bub1b | loop | AKENE (SEQ ID NO: 2866) | GCGAAAGAAAACGAA (SEQ ID NO: 3011) |
| APC/C | Bub1b | loop | SKENV (SEQ ID NO: 2867) | AGCAAAGAAAACGTG (SEQ ID NO: 3012) |
| APC/C TPR1 | Consensus | loop | .[ILM]R$ | NNN[ATT/CTG/ATG]CTG |
| SCF$^{Fbw7}$_1 | Consensus | loop | [LIVMP].{0,2}pTP..[pSpT] | [CTG/ATT/GTT/ATG/CCG][NNN{0,2}]ACCCCGNNNNNN[AGC/ACC] (SEQ ID NO: 3013) |
| SCF$^{Fbw7}$_1 | Neurogenic locus notch homolog protein 1 | loop | PFLpTPpSPE (SEQ ID NO: 2868) | CCGTTTCTGACCCCGAGCCCGGAA (SEQ ID NO: 3014) |
| SCF$^{Fbw7}$_1 | Uracil-DNA glycosylase | loop | PGpTPPSpS (SEQ ID NO: 2869) | CCGGGCACCCCGCCGAGCAGC (SEQ ID NO: 3015) |
| SCF$^{Fbw7}$_1 | G1/S-specific cyclin-E1 | loop | LLpTPPQpS (SEQ ID NO: 2870) | CTGCTGACCCCGCCGCAGAGC (SEQ ID NO: 3016) |
| SCF$^{Fbw7}$_2 | Consensus | loop | [LIVMP].{0,2}pTP..E | [CTG/ATT/GTT/ATG/CCG][NNN{0,2}]ACCCCGNNNNNNGAA (SEQ ID NO: 3017) |
| SCF$^{Fbw7}$_2 | Neurogenic locus notch homolog protein 1 | loop | PFLpTPSPE (SEQ ID NO: 2871) | CCGTTTCTGACCCCGAGCCCGGAA (SEQ ID NO: 3018) |
| SCF$^{Fbw7}$ | G1/S-specific cyclin-E1 | loop | SLIPpTPDK (SEQ ID NO: 2872) | AGCCTGATTCCGACCCCGGATAAA (SEQ ID NO: 3019) |
| SCF$^{Fbw7}$ | cyclin-D3 | loop | PEQTSEPTDVAI (SEQ ID NO: 2873) | CCGGAACAGACCAGCGAACCGACCGATGTTGCAATT (SEQ ID NO: 3020) |
| SCF$^{Fbw7}$ | Sterol regulatory element-binding protein 1 | loop | SDSEPD (SEQ ID NO: 2874) | AGCGATAGCGAACCGGAT (SEQ ID NO: 3021) |

TABLE 3-continued

| | | | | |
|---|---|---|---|---|
| SCF<sup>Fbw7</sup> | SV40 | loop | TPxxE | ACCCCGNNNNNNGAA (SEQ ID NO: 3022) |
| SCF<sup>Fbw7</sup> | cyclin E1 | loop | SLIPEPDR (SEQ ID NO: 2875) | AGCCTGATTCCGGAACCGGATCGT (SEQ ID NO: 3023) |
| SCF<sup>Fbw7</sup> | Nuclear factor NF-kappa-B p105 subunit | loop | pSGVETpSF (SEQ ID NO: 2876) | AGCGGCGTGGAAACCAGCTTT (SEQ ID NO: 3024) |
| SCF<sup>Fbw7</sup> | E3 Ubiquitin ligase RNF157 | loop | LKLKKSL (SEQ ID NO: 2877) | CTGAAACTGAAAAAAGCCTG (SEQ ID NO: 3025) |
| SCF<sup>Fbw7</sup> | NF-kappa-B inhibitor alpha | loop | pSGLDpS (SEQ ID NO: 2878) | AGCGGCCTGGATAGC (SEQ ID NO: 3026) |
| SCF<sup>Fbw7</sup> | NF-kappa-B inhibitor epsilon | loop | DpSGIEpS (SEQ ID NO: 2879) | GATAGCGGCATTGAAAGC (SEQ ID NO: 3027) |
| SCF<sup>Fbw7</sup> | Programmed cell death protein 4 | loop | pSSRDSGRGDS (SEQ ID NO: 2880) | AGCAGCCGCGATAGCGGCCGCGGCGATAGC (SEQ ID NO: 3028) |
| SCF<sup>Fbw7</sup> | NF-kappa-B inhibitor beta | loop | DpSGLGpS (SEQ ID NO: 2881) | GATAGCGGCCTGGGCAGC (SEQ ID NO: 3029) |
| SCF<sup>Fbw8</sup> | myc | loop | EPPLEP (SEQ ID NO: 2882) | GAACCGCCTCTGGAACCG (SEQ ID NO: 3030) |
| SCF_TIR1 | Consensus | loop | .[VLIA][VLI]GWPP[VLI]...R. (SEQ ID NO: 2883) | NNN[GTG/CTG/ATT/GCG][GTG/CTG/ATT]GGT TATCCGCCG[GTG/CTG/ATT] NNNNNNCGTNNN (SEQ ID NO: 3031) |
| Cul4-DDB1-Cdt2_1 | Consensus | loop | [NQ]{0,1}..[ILMV][ST][DEN][FY][FY].{2,3}[KR]{2,3}[^DE] | [AAC/CAG{0,1}]NNNNNNN[ATT/CTG/ATG/GTG][AGC/ACC][GAC/GAA/AAC][TTT/TAT][TTT/TAT][NNN{0,3}][AAA/CGT{2,3}][NNN (∨GAA/GAT)] |
| Cul4-DDB1-Cdt2_2 | Consensus | loop | [NQ]{0,1}..[ILMV]T[DEN][HMFY][FMY].{2,3}[KR]{2,3}[^DE] | [AAC/CAG{0,1}]NNNNNNN[ATT/CTG/ATG/GTG][ACC][GAC/GAA/AAC][CAT/ATG/TTT/TAT][TTT/TAT/ATG][NNN{2,3}][AAA/CGT{2,3}][NNN (∨GAA/GAT)] |
| Cul4-DDB1-Cdt2 | PIP | loop | QRRMTDFYARRR (SEQ ID NO: 2884) | CAGCGTCGTATGACCGATTTTTATGCACGTCGTCGT (SEQ ID NO: 3032) |
| DDB1-CUL4 | paramoxyvirus SV5-V protein | helix | TVAYFTLQQVYG (SEQ ID NO: 2885) | ACCGTTGCATATTTTACCCTGCAGCAGGTTTATGGT (SEQ ID NO: 3033) |
| DDB1-CUL4 | Hepatitis B virus X protein | helix | ILPAVLHLRTVYG (SEQ ID NO: 2886) | ATTCTGCCTGCAGTTCTGCATCTGCGTACCGTTTATGGT (SEQ ID NO: 3034) |
| DDB1-CUL4 | Woodchuck Hepatitis virus X protein | helix | NFVAWHALRQVYG (SEQ ID NO: 2887) | AATTTTGTTGCATGGCATGCACTGCGTCAGGTTTATGGT (SEQ ID NO: 3035) |
| DDB1-CUL5 | DCAF9 | helix | NITADLILRQVYG (SEQ ID NO: 2888) | AACATTACCGCAGATCTGATTCTGCGTCAGGTTTATGGT (SEQ ID NO: 3036) |
| Unknown | Bonger | loop | RRRG (SEQ ID NO: 2889) | CGTCGTCGTGGT (SEQ ID NO: 3037) |
| SOCS box-Cul5-SPSB2 | iNOS | loop | DINN (SEQ ID NO: 2890) | GACATCAACAAC (SEQ ID NO: 3038) |
| SCF_TRCP1_1 | Consensus | loop | DpSG.{2,3}[pSpt] | GATAGCGGC[NNN{2,3}][AGC/ACC] (SEQ ID NO: 3039) |
| SCF_TRCP1_1 | SETBP1 | loop | DSGIGT (SEQ ID NO: 2891) | GATAGCGGCATTGGCACC (SEQ ID NO: 3040) |
| β-TRCP | β-catenin | loop | DEGNYE (SEQ ID NO: 2892) | GATGAAGGCAACTATGAA (SEQ ID NO: 3041) |

TABLE 3-continued

| | | | | |
|---|---|---|---|---|
| β-TRCP | Vpu | loop | DSGxxS (SEQ ID NO: 2893) | GATAGCGGCNNNNNNAGC (SEQ ID NO: 3042) |
| β-TRCP | RE1-silencing transcription factor | loop | SEGSDDSGL (SEQ ID NO: 2894) | AGCGAAGGCAGCGATGATAGCGGCCTG (SEQ ID NO: 3043) |
| β-TRCP | Prolactin receptor | loop | TDSGRGS (SEQ ID NO: 2895) | ACCGATAGCGGCCGCGGCAGC (SEQ ID NO: 3044) |
| β-TRCP | Protein aurora borealis | loop | DSGYNT (SEQ ID NO: 2896) | GATAGCGGCTATAACACC (SEQ ID NO: 3045) |
| β-TRCP | Vaccinia virus | loop | YSGNLEpS (SEQ ID NO: 2897) | TATAGCGGCAACCTGGAAAGC (SEQ ID NO: 3046) |
| SCF<sup>Fbw2</sup> | G1/S-specific cyclin-D3 | loop | pSQTSTPTDVTAIHL (SEQ ID NO: 2898) | AGCCAGACCAGCACCCCGACCGATGTGACCGCGATT CATCTG (SEQ ID NO: 3047) |
| SCF<sup>Fbw3</sup> | G1/S-specific cyclin-D3 | loop | PTDVTAI (SEQ ID NO: 2899) | CCGACCGATGTGACCGCGATT (SEQ ID NO: 3048) |
| SCF<sup>Fbw4</sup> | cyclin D1 | loop | EEEVSLASEPTDVRD (SEQ ID NO: 2900) | GAAGAAGAAGTTAGCCTGGCAAGCGAACCGACCGAT GTTCGTGAT (SEQ ID NO: 3049) |
| OPDH VHL 1 | consensus | loop | [IL]ApT.{6,8}[FLIVM].[FLIVM] | [ATT/CTG]GCGACC[NNN{6,8}][TTT/CTG/ATT/GTG/ATG]NNN[TTT/CTG/ATT/GTG/ATG] (SEQ ID NO: 3050) |
| SCF coil | consensus | loop | [RK][RK].SL.F[FLM].[RK]R[HRK]. (SEQ ID NO: 2901) | [CGT/AAA][CGT/AAA]NNNAGCCTGNNNTTT[TTT/CTA/ATG]NNN[CGT/AAA]CGT[CGT/AAA/CAT]NNN[CGT/AAA] (SEQ ID NO: 3051) |
| CHIP | Hsp90 | loop or C-terminus | ASRMEEVD (SEQ ID NO: 2902) | GCAAGCCGTATGGAAGAAGTTGAT (SEQ ID NO: 3052) |
| CHIP | Hsp70 | loop or C-terminus | GPTIEEVD (SEQ ID NO: 2903) | GGTCCGACCATTGAAGAAGTTGAT (SEQ ID NO: 3053) |
| SOCS box-Cul5-SPSB4 | VASA | loop | DINNNNNIVEDVERKREFYI (SEQ ID NO: 2904) | GACATCAACAACAACAACATCGTTGAAGACGTT GAACGTAAACGTGAATTCTATATC (SEQ ID NO: 3054) |
| UBR5 | PAM2 | loop | SKLSVNAPEFYPSG (SEQ ID NO: 2905) | TCTAAACTGTCTGTTAACGCGCCGGAATTCTACCCG TCTGGT (SEQ ID NO: 3055) |
| CRL2(KLHDC2) | Usp1 | C-terminu | IGLLGG (SEQ ID NO: 2906) | ATCGGTCTGCTGGGTGGT (SEQ ID NO: 3056) |
| CID4 | Pro/N-degron | N-terminu | PGLW (SEQ ID NO: 2907) | CCGGGTCTGTGG (SEQ ID NO: 3057) |
| TRIM21 | Fc fragment | loop | WxW | TGGNNNTGG |
| TRIM21 | Fc fragment | loop | HNH | CATAACCAT |
| Nedd4 | PPxY motif | loop | TAPPPAYATLG (SEQ ID NO: 2908) | ACCGCGCCGCCGCCGGCGTATGCGACCCTGGGC (SEQ ID NO: 3058) |
| Elongin C | Vif | loop | SLxxxLxxxI (SEQ ID NO: 2909) | AGCCTGNNNNNNNNNCTGNNNNNNNNNATT (SEQ ID NO: 3059) |
| Unknown | ID2 | loop | SRTPLTTLN (SEQ ID NO: 2910) | AGCCGCACCCCGCTGACCACCCTGAAC (SEQ ID NO: 3060) |
| Unknown | ZAP70 | loop | DGYTPEP (SEQ ID NO: 2911) | GATGGCTATACCCCGGAACCG (SEQ ID NO: 3061) |
| Unknown | SH3R1 | loop | RPTAAVTPI (SEQ ID NO: 2912) | CGCCCGACCGCGGCGGTGACCCCGATT (SEQ ID NO: 3062) |
| Unknown | ETV1 | loop | DEQFVPD (SEQ ID NO: 2913) | GATGAACAGTTTGTGCCGGAT (SEQ ID NO: 3063) |

TABLE 3-continued

| | | | | |
|---|---|---|---|---|
| Unknown | EPAS1 | loop | LAPYIPMDGEDFQL (SEQ ID NO: 2914) | CTGGCGCCGTATATTCCGATGGATGGCGAAGATTTTCAGCTG (SEQ ID NO: 3064) |
| Unknown | hantavirus | loop | YVGLVWGVLLTTELIVWAASA (SEQ ID NO: 2915) | TATGTGGGCCTGGTGTGGGGCGTGCTGCTGACCACCGAACTGATTGTGTGGGCGGCGAGCGCG (SEQ ID NO: 3065) |
| CRL4_CDT2_1 | SETD8 | loop | PKTPPSSCDSTN (SEQ ID NO: 2916) | CCGAAAACCCCGCCGAGCAGCTGCGATAGCACCAAC (SEQ ID NO: 3066) |
| CBL (PTK) | Consensus | loop | [DN].pY[ST].P | [GAT/AAC]NNNTAT[AGC/ACC]NNNCCG (SEQ ID NO: 3067) |
| CBL (met) | Consensus | loop | DpYR | GATTATCGT |
| CBL | SH2B adapter protein 3 | loop | RAIDNQYTPL (SEQ ID NO: 2917) | CGCGCGATTGATAACCAGTATACCCCGCTG (SEQ ID NO: 3068) |
| CBL | Protein sprouty homolog 1 | loop | IRGSNEYTEGPS (SEQ ID NO: 2918) | ATTCGCGGCAGCAACGAATATACCGAAGGCCCGAGC (SEQ ID NO: 3069) |
| CBL | Protein sprouty homolog 2 | loop | IRNTNEYTEGPT (SEQ ID NO: 2919) | ATTCGCAACACCAACGAATATACCGAAGGCCCGACC (SEQ ID NO: 3070) |
| CBL | Protein sprouty homolog 4 | loop | HVENDYIDNPS (SEQ ID NO: 2920) | CATGTGGAAAACGATTATATTGATAACCCGAGC (SEQ ID NO: 3071) |
| CBL | Tyrosine-protein kinase SYK | loop | SFNPYEPELA (SEQ ID NO: 2921) | AGCTTTAACCCGTATGAACCGGAACTGGCG (SEQ ID NO: 3072) |
| CBL | Tyrosine-protein kinase ZAP-70 | loop | TLNSDGpYTPEPA (SEQ ID NO: 2922) | ACCCTGAACAGCGATGGCTATACCCCGGAACCGGCG (SEQ ID NO: 3073) |
| CBL | Plexin-A3 | loop | IPFLDYRTYAV (SEQ ID NO: 2923) | ATTCCGTTTCTGGATTATCGCACCTATGCGGTG (SEQ ID NO: 3074) |
| CBL | Plexin-A1 | loop | IPFLDYRTYAM (SEQ ID NO: 2924) | ATTCCGTTTCTGGATTATCGCACCTATGCGATG (SEQ ID NO: 3075) |
| CBL | Platelet-derived growth factor receptor alpha | loop | SIFDNLYTTLSD (SEQ ID NO: 2925) | AGCATTTTTAACAGCCTGTATACCACCCTGAGCGAT (SEQ ID NO: 3076) |
| CBL | Platelet-derived growth factor receptor beta | loop | SIFNSLYTTLSD (SEQ ID NO: 2926) | AGCATTTTTAACAGCCTGTATACCACCCTGAGCGAT (SEQ ID NO: 3077) |
| CBL | Tumor necrosis factor receptor superfamily member 16 | loop | KGDGGLYSSLPP (SEQ ID NO: 2927) | AAAGGCGATGGCGGCCTGTATAGCAGCCTGCCGCCG (SEQ ID NO: 3078) |
| CRL4(COP1/DET) | Trib1 | loop | SDQIVPEY (SEQ ID NO: 2928) | TCTGACCAGATCGTTCCGGAATAC (SEQ ID NO: 3079) |
| SH3RF1 | E3 Ubiquitin-protein ligase SH3RF1 | loop | RPTAAVTPI (SEQ ID NO: 2929) | CGCCCGACCGCGGCGGTGACCCCGATT (SEQ ID NO: 3080) |
| COP-1 | Consensus | loop | [D,E][D,E].{2,3} VP[DE] | [GAA/GAC][GAA/GACHNNNNNN/NNNNNNNNN] GTGCCG[GAA/GAC] (SEQ ID NO: 3081) |
| COP-1 | Tribbles homolog 1 | loop | SDQIVPEY (SEQ ID NO: 2930) | AGCGATCAGATTGTGCCGGAATAT (SEQ ID NO: 3082) |
| SIAH | Consensus | loop | .P.A.V.P[^P] (SEQ ID NO: 2931) | NNNCCGNNNGCGNNNGTGNNNCCG[NNN EXCEPT CCN] (SEQ ID NO: 3083) |
| SIAH | AF4/FMR2 family memeber 4 | loop (beta sttrand) | KPTAYVRPM (SEQ ID NO: 2932) | AAACCGACCGCGTATGTGCGCCCGATG (SEQ ID NO: 3084) |

TABLE 3-continued

| | | | | |
|---|---|---|---|---|
| SIAH | calcyclin-binding protein | loop | KPAAVVAPI (SEQ ID NO: 2933) | AAACCGGCGGCGGTGGTGGCGCCGATT (SEQ ID NO: 3085) |
| SIAH | POU domain class 2-associating factor 1 | loop | APTAVVLPH (SEQ ID NO: 2934) | GCGCCGACCGCGGTGGTGCTGCCGCAT (SEQ ID NO: 3086) |
| SIAH | Retrotransposon-derived protein PEG10 | loop | PPRALVLPH (SEQ ID NO: 2935) | CCGCCGCGCGCGCTGGTGCTGCCGCAT (SEQ ID NO: 3087) |
| ERAD-C | CL1 | amphipathic helix extension | ACKNWFSSLSHFVIHL (SEQ ID NO: 2936) | GCGTGCAAAAACTGGTTTAGCAGCCTGAGCCATTTT GTGATTCATCTG (SEQ ID NO: 3088) |
| | Nend_Nbox 2 | N-terminal extension | ^M{0,1}[FLYIW][\/P] | [ATG{0,1}][TTT/CTG/TAT/TGG/ATT] [NNN\/CCG] |
| | Nend_UBRbox 1 | N-terminal extension | ^M{0,1}[RK][\/P] | [ATG{0,1}][AAA/CGT][NNN\/CCG] |
| | Nend_UBRbox 2 | N-terminal extension | ^M{0,1}[ED] | [ATG{0,1}][GAT/GAA] |
| | Nend_UBRbox 3 | N-terminal extension | ^M{0,1}[NQ] | [ATG{0,1}][CAG/AAC] |
| | Nend_UBRbox 4 | N-terminal extension | ^M{0,1}[C] | [ATG{0,1}][TGC] |

| Other degradation pathways: pathway; protein to which the degron binds | Degron sequence derived from | Introduction to scaffold | Amino acid sequence | DNA sequence E. Coli codon optimised 5' to 3' |
|---|---|---|---|---|
| ESRCT; ALIX | Consensus, e.g. HIV Gag | loop | LYPxxxL, (SEQ ID NO: 2937) e.g. ELYPLTSLRS (SEQ ID NO: 2937) | GAACTGTACCCGCTGACCTCTCTGCGTTCT (SEQ ID NO: 3089) |
| ESCRT; AP-1 | Nef | loop | ExxxLL | GAANNNNNNNNNCTGCTG (SEQ ID NO: 3090) |
| ESCRT; AP-2 | Env | loop | YxxL | TATNNNNNNCTG (SEQ ID NO: 3091) |
| ESCRT; AP | viral adaptor | loop | SREKPYKEVTEDLLHLNSLF (SEQ ID NO: 2939) | AGCCGCGAAAAACCGTATAAAGAAGTGACCGAAGAT CTGCTGCATCTGAACAGCCTGTTT (SEQ ID NO: 3092) |
| ESCRT; AP | viral adaptor | loop | AAGAYDPARKLLEQYAKK (SEQ ID NO: 2940) | GCGGCGGGCGCGTATGATCCGGCGCGCAAACTGCTG GAACAGTATGCGAAAAAA (SEQ ID NO: 3093) |
| CMA | Consensus | loop | KFERQ (SEQ ID NO: 2941) | AAATTTGAACGCCAG (SEQ ID NO: 3094) |
| CMA | Consensus | loop | QRFFE (SEQ ID NO: 2942) | CAGCGCTTTTTTGAA (SEQ ID NO: 3095) |
| Autophagy; LC3/Atg8 family | Consensus LIR (LC3-interacting)/ AIM (Atg8 family-interacting) motif | loop | [W/F/Y]xx[L/I/V] | (TGG/TTC/TAT)NNNNNN(CTG/ATC/GTG) |
| Autophagy; FIP200 | CCPG1 | loop | TASDDSDIVTLEPPK (SEQ ID NO: 2943) | ACCGCGTCTGACGACTCTGACATCGTTACCCTGGAA CCGCCGAAA (SEQ ID NO: 3096) |
| Autophagy; LC3 | DVL | loop | EVRDRMWLKITI (SEQ ID NO: 2944) | GAAGTTCGTGACCGTATGTGGCTGAAAATCACCATC (SEQ ID NO: 3097) |

TABLE 3-continued

```
KEY
.                    any amino acid
[X]                  allowed amino acid at the position
p                    phosphorylated amino acid
$                    C-terminal of chain
^X                   N-terminal of chain
X{x,y}               where x & y are the minimum, maximum of X aminoacids at the position
[\X]                 amino acid not allowed at the position
NNN                  any condon
[NNN/NNN/NNN]        on of these condons at the position
[\NNN]               any condon except this
[NNN{x,y}]           condon, where x & y are the maximun & minimum of condons
```

TABLE 4

Multiple Alignment of DNA sequences of all CTPR and RTPR used in hetero-bifunctional CTPRs and RTPRs
CLUSTAL multiple sequence alignment by MUSCLE (3.8)

```
RTPRc         GCAGAAGCACTGCGTAATCTGGGTCGTGTTTATCGTCGTCAGGGTCGTTATCAGCGTGCA
RTPRa-ii-H    GCCGAAGCTTGGTATAATCTGGGGAATGCCTATTACAGACAGGGGGATTATCAGCGCGCC
RTPRa-i-E     GCAGAAGCATGGTATAATCTGGGTAATGCCATATTATCGCCAGGGTGATTATCAGCGTGCC
RTPRa-iii-E   GCAGAAGCATGGTATAATCTGGGCAATGCATATTATCGTCAGGGTGATTATCAGCGTGCC
CTPRa-E       GCAGAAGCATGGTATAATCTGGGTAATGCATATTACAAACAGGGCGATTATCAGAAAGCC
CTPRb-E       GCAGAAGCACTGAATAATCTGGGTAATGTTTATCGTGAACAGGGCGATTATCAGAAAGCC
RTPRb-E       GCAGAAGCACTGAATAATCTGGGTAATGTTTATCGTGAACAGGGCGATTATCAGCGTGCC
RTPRa-ii-E    GCCGAGGCCTGGTATAACCTTGGCAACGCCTATTATCGTCAAGGCGACTACCAGAGAGCA
RTPRc-H       GCCGAGGCTCTGAGAAATCTGGGCAGAGTGTACAGACGGCAGGGCAGATACCAGCGGGCC
CTPRb-H       GCCGAGGCTCTGAACAACCTGGGCAACGTGTACAGAGAGCAGGGCGACTACCAGAAGGCC
RTPRb-H       GCCGAGGCTCTGAACAACCTGGGCAACGTGTACAGAGAGCAGGGCGACTACCAGCGGGCC
RTPRa-iv-E    GCCGAGGCCTGGTACAACCTGGGTAACGCCTATTATCGCCAAGGCGACTACCAGCGTGCA
CTPRa-H       GCCGAGGCCTGGTACAATCTGGGCAACGCCTACTACAAGCAGGGCGACTACCAGAAGGCC
RTPRa-i-H     GCCGAGGCCTGGTACAACCTGGGCAACGCCTACTACCGGCAGGGCGACTACCAGCGGGCC
              ** ** **   *  ** ** **    * **       ** **       ** ***   **

RTPRc         ATTGAATATTATCGTCGCGCACTGGAATTAGATCCGNNNNNN   (SEQ ID NO: 148)
RTPRa-ii-H    ATTGAATATTATCAGCGGGCTCTGGAACTGGATCCTNNNNNN   (SEQ ID NO: 149)
RTPRa-i-E     ATTGAATATTATCAACGTGCACTGGAACTGGACCCGNNNNNN   (SEQ ID NO: 150)
RTPRa-iii-E   ATCGAATATTATCAACGTGCACTGGAACTGGACCCGNNNNNN   (SEQ ID NO: 151)
CTPRa-E       ATCGAGTATTATCAAAAAGCACTGGAACTGGACCCGNNNNNN   (SEQ ID NO: 152)
CTPRb-E       ATCGAATATTATCAAAAAGCGCTGGAACTGGACCCGNNNNNN   (SEQ ID NO: 153)
RTPRb-E       ATTGAATATTATCAACGTGCGCTGGAATTAGATCCGNNNNNN   (SEQ ID NO: 154)
RTPRa-ii-E    ATCGAATATTACCAGCGTGCGTTAGAATTAGACCCGNNNNNN   (SEQ ID NO: 155)
RTPRc-H       ATCGAGTATTACCGCAGAGCCCTGGAACTGGACCCCNNNNNN   (SEQ ID NO: 156)
CTPRb-H       ATCGAGTATTATCAGAAGGCCCTGGAACTGGACCCCNNNNNN   (SEQ ID NO: 157)
RTPRb-H       ATCGAGTATTATCAGAGAGCCCTGGAACTGGACCCCNNNNNN   (SEQ ID NO: 158)
RTPRa-iv-E    ATTGAGTACTACCAACGTGCCCTGGAACTGGACCCTNNNNNN   (SEQ ID NO: 159)
CTPRa-H       ATCGAGTATTATCAAGGCCCTGGAACTGGACCCCNNNNNN     (SEQ ID NO: 160)
RTPRa-i-H     ATCGAGTACTACCAGAGAGCCCTGGAACTGGACCCTNNNNNN   (SEQ ID NO: 161)
              ** ** ** **  *      **  * *** * ** ** ******
```

TABLE 5

| 089 | AEAYSNLGNVYKERGQLQEAIEHYRHALRL | 118 | NP_858058.1 (SEQ ID NO: 162) |
|---|---|---|---|
| 191 | AVAWSNLGCVFNAQGEIWLAIHHFEKAVTL | 220 | (SEQ ID NO: 163) |
| 327 | ADSLNNLANIKREQGNIEEAVRLYRKALEV | 356 | (SEQ ID NO: 164) |
| 264 | NLACVYYEQGLIDLAIDTYRRAIEL | 288 | (SEQ ID NO: 165) |
| 079 | AEAYSNLGNVYKERGQLQEAIEHYRHALRL | 108 | NP_858059.1 (SEQ ID NO: 166) |
| 181 | AVAWSNLGCVFNAQGEIWLAIHHFEKAVTL | 210 | (SEQ ID NO: 167) |
| 317 | ADSLNNLANIKREQGNIEEAVRLYRKALEV | 346 | (SEQ ID NO: 168) |
| 254 | NLACVYYEQGLIDLAIDTYRRAIEL | 278 | (SEQ ID NO: 169) |
| 079 | AEAYSNLGNVYKERGQLQEAIEHYRHALRL | 108 | NP_003596.2 (SEQ ID NO: 170) |

TABLE 5-continued

| Start | Sequence | End | Accession (SEQ ID NO) |
|---|---|---|---|
| 812 | ESFYNLGRGLHQLGLIHLAIHYYQKALEL | 840 | NP_036218.1 (SEQ ID NO: 171) |
| 637 | AWYGLGMIYYKQEKFSLAEMHFQKALDI | 664 | NP_001247.2 (SEQ ID NO: 172) |
| 568 | EAWCAAGNCFSLQREHDIAIKFFQRAIQV | 596 | (SEQ ID NO: 173) |
| 275 | AQSCYSLGNTYTLLQDYEKAIDYHLKHLAI | 304 | (SEQ ID NO: 174) |
| 058 | YSQLGNAYFYLHDYAKALEYHHHDLTL | 084 | (SEQ ID NO: 175) |
| 315 | GRACWSLGNAYTALGNHDQAMHFAEKHLEI | 344 | (SEQ ID NO: 176) |
| 247 | NMGNIYLKQRNYSKAIKFYRMALD | 270 | NP_783195.2 (SEQ ID NO: 177) |
| 495 | ALTNKGNTVFANGDYEKAAEFYKEAL | 520 | (SEQ ID NO: 178) |
| 238 | NMGNIYLKQRNYSKAIKFYRMALD | 261 | NP_006522.2 (SEQ ID NO: 179) |
| 486 | ALTNKGNTVFANGDYEKAAEFYKEAL | 511 | (SEQ ID NO: 180) |
| 715 | AQAWMNMGGIQHIKGKYVSARAYYERALQL | 744 | NP_787057.2 (SEQ ID NO: 181) |
| 575 | AEILSPLGALYYNTGRYEEALQIYQEAAAL | 604 | (SEQ ID NO: 182) |
| 114 | AQAAKNKGNKYFKAGKYEQAIQCYTEAISL | 143 | NP_055635.3 (SEQ ID NO: 183) |
| 610 | YNLGKLYHEQGHYEEALSVYKEAIQ | 634 | NP_689801.1 (SEQ ID NO: 184) |
| 586 | AQAWMNMGGIQHIKGKYVSARAYYERALQL | 615 | NP_114126.2 (SEQ ID NO: 185) |
| 446 | AEILSPLGALYYNTGRYEEALQIYQEA | 472 | (SEQ ID NO: 186) |
| 018 | AETFKEQGNAYYAKKDYNEAYNYYTKAIDM | 47 | NP_003306.1 (SEQ ID NO: 187) |
| 300 | AKAYARIGNSYFKEEKYKDAIHFYNKSL | 327 | NP_006810.1 (SEQ ID NO: 188) |
| 231 | LGNDAYKKKDFDTALKHYDKAKEL | 254 | (SEQ ID NO: 189) |
| 365 | NKGNECFQKGDYPQAMKHYTEAI | 387 | (SEQ ID NO: 190) |
| 028 | AETFKEQGNAYYAKKDYNEAYNYYTKAIDM | 057 | AAH11837.2 (SEQ ID NO: 191) |
| 228 | AYSNLGNAHVFLGRFDVAAEYYKKTLQL | 255 | NP_056412.2 (SEQ ID NO: 192) |
| 266 | AQACYSLGNTYTLLQDYERAAEYHLRHL | 293 | (SEQ ID NO: 193) |
| 28 | AEELKTQANDYFKAKDYENAIKFYSQAIEL | 57 | NP_006238.1 (SEQ ID NO: 194) |
| 318 | DAYKSLGQAYRELGNFEAATESFQKALLL | 346 | NP_078801.2 (SEQ ID NO: 195) |
| 1262 | ETLKNLAVLSYEGGDFEKAAELYKRAMEI | 1290 | NP_694972.3 (SEQ ID NO: 196) |
| 140 | GNKYFKQGKYDEAIDCYTKGMD | 161 | NP_078880.1 (SEQ ID NO: 197) |
| 289 | GNGFFKEGKYERAIECYTRGI | 309 | (SEQ ID NO: 198) |
| 600 | CWESLGEAYLSRGGYTTALKSFTKASEL | 627 | NP_055454.1 (SEQ ID NO: 199) |
| 172 | KATYRAGIAFYHLGDYARALRYLQEA | 197 | NP_689692.2 (SEQ ID NO: 200) |

TABLE 5-continued

| | | | |
|---|---|---|---|
| 174 | LGKIHLLEGDLDKAIEVYKKAVE | 196 | NP_149017.2 (SEQ ID NO: 201) |
| 158 | LGDLFSKAGDFPRAAEAYQKQLRF | 181 | NP_038460.3 (SEQ ID NO: 202) |
| 384 | AYFNAGNIYFHHRQFSQASDYFSKALKF | 411 | NP_001007796.1 (SEQ ID NO: 203) |
| 104 | EAWNQLGEVYWKKGDVAAAHTCFSGAL | 130 | NP_612385.1 (SEQ ID NO: 204) |
| 814 | EAWQGLGEVLQAQGQNEAAVDCFLTALEL | 842 | NP_065191.2 (SEQ ID NO: 205) |
| 446 | AKLWNNVGHALENEKNFERALKYFLQA | 472 | NP_861448.1 (SEQ ID NO: 206) |
| 597 | ADLWYNLAIVHIELKEPNEALKNFNRALEL | 626 | (SEQ ID NO: 207) |
| 251 | YRRKGDLDKAIELFQRVLE | 269 | NP_001540.2 (SEQ ID NO: 208) |
| 251 | YRRKGDLDKAIELFQRVLE | 269 | NP_001026853.1 (SEQ ID NO: 209) |
| 079 | AKTYKDEGNDYFKEKDYKKAVISYTEGL | 106 | NP_004614.2 (SEQ ID NO: 210) |
| 501 | AKVHYNIGKNLADKGNQTAAIRYYREAVRL | 530 | NP_116202.2 (SEQ ID NO: 211) |
| 482 | AKVHYNIGKNLADKGNQTAAIRYYREAVRL | 511 | NP_001073137.1 (SEQ ID NO: 212) |
| 200 | GNELVKKGNHKKAIEKYSESL | 220 | NP_006800.2 (SEQ ID NO: 213) |
| 123 | GNEQFKKGDYIEAESSYSRALEM | 145 | NP_003305.1 (SEQ ID NO: 214) |
| 438 | ESLSLLGFVYKLEGNMNEALEYYERALRL | 466 | NP_001001887.1 (SEQ ID NO: 215) |
| 438 | ESLSLLGFVYKLEGNMNEALEYYERALRL | 466 | NP_001539.3 (SEQ ID NO: 216) |
| 375 | AKTKNNLASAYLKQNKYQQAEELYKEIL | 402 | NP_803136.2 (SEQ ID NO: 217) |
| 564 | WFSLGCAYLALEDYQGSAKAFQRCVTL | 590 | NP_060205.3 (SEQ ID NO: 218) |
| 306 | AESCYQLARSFHVQEDYDQAFQYYYQATQF | 335 | NP_055448.1 (SEQ ID NO: 219) |

TABLE 6

CTPRa *E. coli* expression codon optimised
GCAGAAGCATGGTATAATCTGGGTAATGCATATTACAAACAGGGCGATTA
TCAGAAAGCCATCGAGTATTATCAAAAAGCACTGGAACTGGACCCGNNNN
NNAEAWYNLGNAYYKQGDYQKAIEYYQKALELDPXX
(SEQ ID NO: 220)

CTPRa *H. Sapiens* expression codon optimised
GCCGAGGCCTGGTACAATCTGGGCAACGCCTACTACAAGCAGGGCGACTA
CCAGAAGGCCATCGAGTATTATCAGAAGGCCCTGGAACTGGACCCCNNNN
NNAEAWYNLGNAYYKQGDYQKAIEYYQKALELDPXX
(SEQ ID NO: 220)

RTPRa-i *H. sapiens* expression codon optimised
GCCGAGGCCTGGTACAACCTGGGCAACGCCTACTACCGGCAGGGCGACTA
CCAGCGGGCCATCGAGTATTATCAGAAGGCCCTGGAACTGGACCCTNNNN
NNAEAWYNLGNAYYRQGDYQRAIEYYQRALELDPXX
(SEQ ID NO: 221)

RTPRa-ii *H. sapiens* expression codon optimised
GCCGAAGCTTGGTATAATCTGGGGAATGCCTATTACAGACAGGGGGATTA TABLE 6-continued TCAGCGCGCCATTGAATATTATCAGCGGGCTCTGGAACTGGATCCTNNNN
NNAEAWYNLGNAYYRQGDYQRAIEYYQRALELDPXX
(SEQ ID NO: 221)

RTPRa-i *E. coli* expression codon optimised
GCAGAAGCATGGTATAATCTGGGTAATGCATATTATCGCCAGGGTGATTA
TCAGCGTGCCATTGAATATTATCAACGTGCACTGGAACTGGACCCGNNNN
NNAEAWYNLGNAYYRQGDYQRAIEYYQRALELDPXX
(SEQ ID NO: 221)

RTPRa-ii *E. coli* expression codon optimised
GCCGAGGCCTGGTATAACCTTGGCAACGCCTATTATCGTCAAGGCGACTA
CCAGAGAGCAATCGAATATTACCAGCGTGCGTTAGAATTAGATCCGNNNN
NNAEAWYNLGNAYYRQGDYQRAIEYYQRALELDPXX
(SEQ ID NO: 221)

RTPRa-iii *E. coli* expression codon optimised
GCAGAAGCATGGTATAATCTGGGCAATGCATATTATCGTCAGGGTGATTA
TCAGCGTGCCATCGAATATTATCAACGTGCACTGGAACTGGACCCGNNNN TABLE 6-continued

NNAEAWYNLGNAYYRQGDYQRAIEYYQRALELDPXX
(SEQ ID NO: 221)

RTPRa-iv E. coli expression codon optimised
GCCGAGGCCTGGTACAACCTGGGTAACGCCTATTATCGCCAAGGCGACTA
CCAGCGTGCAATTGAGTACTACCAACGTGCCCTGGAACTGGACCCTNNNN
NNAEAWYNLGNAYYRQGDYQRAIEYYQRALELDPXX
(SEQ ID NO: 221)

CTPRb E. coli expression codon optimised
GCAGAAGCACTGAATAATCTGGGTAATGTTTATCGTGAACAGGGCGATTA
TCAGAAAGCCATCGAATATTATCAAAAAGCGCTGGAACTGGACCCGNNNN
NNAEALNNLGNVYREQGDYQKAIEYYQKALEL-DPXX
(SEQ ID NO: 222)

CTPRb H. sapiens expression codon optimised
GCCGAGGCTCTGAACAACCTGGGCAACGTGTACAGAGAGCAGGGCGACTA
CCAGAAGGCCATCGAGTATTATCAGAAGGCCCTGGAACTGGACCCCNNNN
NNAEALNNLGNVYREQGDYQKAIEYYQKALEL-DPXX
(SEQ ID NO: 222)

RTPRb E. coli expression codon optimised
GCAGAAGCACTGAATAATCTGGGTAATGTTTATCGTGAACAGGGCGATTA
TCAGCGTGCCATTGAATATTATCAACGTGCGCTGGAATTAGATCCGNNNN
NNAEALNNLGNVYREQGDYQRAIEYYQRALEL-DPXX
(SEQ ID NO: 223)

RTPRb H. sapiens expression codon optimised
GCCGAGGCTCTGAACAACCTGGGCAACGTGTACAGAGAGCAGGGCGACTA
CCAGCGGGCCATCGAGTATTATCAGAGAGCCCTGGAACTGGACCCCNNNN
NNAEALNNLGNVYREQGDYQRAIEYYQRALELDPXX
(SEQ ID NO: 223)

RTPRc E. Coli expression codon optimised
GCAGAAGCACTGCGTAATCTGGGTCGTGTTTATCGTCGTCAGGGTCGTTA
TCAGCGTGCAATTGAATATTATCGTCGCGCACTGGAATTAGATCCGNNNN
NNAEALRNLGRVYRRQGRYQRAIEYYRRALELDPXX
(SEQ ID NO: 225)

RTPRc H. Sapiens expression codon optimised
GCCGAGGCTCTGAGAAATCTGGGCAGAGTGTACAGACGCAGGGCAGATA
CCAGAGGGCCATCGAGTATTACCGCAGAGCCCTGGAACTGGACCCCNNNN
NNAEALRNLGRVYRRQGRYQRAIEYYRRALELDPXX
(SEQ ID NO: 225)

TABLE 7

| Protein Target | Paratope | struct | RSCB no | therapeutic area |
| --- | --- | --- | --- | --- |
| Nrp1/2 | RASQYFSSYLA (SEQ ID NO: 226) | loop | 2qqn | anti-angiogenic |
| Nrp1/2 | AREDFRNRRLWYVMDY (SEQ ID NO: 227) | helix | 2qql | anti-angiogenic |
| IL18 | KASGYSFTDYFIY (SEQ ID NO: 228) | helix | 2yxt | anti-inflammatory |
| IL15 | YRDRRRPS (SEQ ID NO: 229) | loop | 2xqb | anti-inflammatory |
| Thyroid stimulating hormone receptor | SGSSSDIGSNYVS (SEQ ID NO: 230) | loop | 2xwt | |
| EGF receptor | QQWSSHIFT (SEQ ID NO: 231) | loop | 3C09 | cancer |
| EGF receptor | ASRDYDYAGRYFDY (SEQ ID NO: 232) | helix | 3C09 | cancer |
| IL23 | QNGHSFPFT (SEQ ID NO: 233) | loop | 3d85 | anti-inflammatory |
| IL23 | YINPYNDGTK (SEQ ID NO: 234) | helix | 3d85 | anti-inflammatory |
| IL23 | ARNWDVAY (SEQ ID NO: 235) | helix | 3d85 | anti-inflammatory |
| Lymphocyte function-associated antigen 1 (LFA-1) | SGYSFTGHWMN (SEQ ID NO: 236) | helix | 3eoa | auto-immune |
| Lymphocyte function-associated antigen 1 (LFA-1) | MIHPSDSETR (SEQ ID NO: 237) | helix | 3eoa | auto-immune |
| Lymphocyte function-associated antigen 1 (LFA-1) | ARGIYFYGTTYFDY (SEQ ID NO: 238) | helix | 3eoa | auto-immune |
| C3b | SGFSFTSSVS (SEQ ID NO: 239) | helix | 3g6j | anti-inflammatory |
| C3b | LIYPYNGFN (SEQ ID NO: 240) | helix | 3g6j | anti-inflammatory |
| FGF receptor 3 | AASGFTFTSTGIS (SEQ ID NO: 241) | helix | 3grw | multiple myeloma |
| FGF receptor 3 | ARTYGIYDLYVDYTE (SEQ ID NO: 242) | helix | 3grw | multiple myeloma |

TABLE 7-continued

| Protein Target | Paratope | struct | RSCB no | therapeutic area |
|---|---|---|---|---|
| IL2 | SRDYGYYFD (SEQ ID NO: 243) | helix | 3iu3 | anti-inflammatory |
| IL2 | GYSFTRYWMH (SEQ ID NO: 244) | helix | 3iu3 | anti-inflammatory |
| HER2 | QWWWWPST (SEQ ID NO: 245) | loop | 3n85 | breast cancer |
| HER2 | ASGFSIWWSWIH (SEQ ID NO: 246) | helix | 3n85 | breast cancer |
| membrane-type serine protease 1 | YDNNQRPS (SEQ ID NO: 247) | loop | 3nps | metastasis of carcinomas |
| membrane-type serine protease 1 | TFHIRRYRSGYYDKMDH (SEQ ID NO: 248) | helix | 3nps | metastasis of carcinomas |
| beta-secretase | ARGPFSPWVMDY (SEQ ID NO: 249) | helix | 3r1g | Alzheimer's disease |
| VEGF-R | TRHDGTNFD (SEQ ID NO: 250) | helix | 3s35 | anti-angiogenic |
| VEGF-R | QQAKAFPPT (SEQ ID NO: 251) | loop | 3s37 | anti-angiogenic |
| lrp5/6 receptor | SGHVNAVKNYGY (SEQ ID NO: 252) | helix | 3sob | bone-loss |
| hepsin protease | WINTETGS (SEQ ID NO: 253) | Helix | 3t2n | prostrate cancer |
| Factor D | WINTYTGE (SEQ ID NO: 254) | helix | 4d9r | anti-inflammatory |
| Factor D | GYTFTNYGMN (SEQ ID NO: 255) | helix | 4d9r | anti-inflammatory |

TABLE 8

1. Axin-RTPR-ABBA
MGSGAYPEYILDIHVYRVQLELDPNNAEAWYNLGNAYYRQGDYQRAIEYY
QRALELDPNNAEAWYNLGNAYYRQGDYQRAIEYYQRALELDPGGSLSSAF
HVFEDGNKENGGPNAEAWYNLGNAYYRQGDYQRAIEYYQRALELDPNN
(SEQ ID NO: 256)

2. Axin-RTPR-DBOX
MGSGAYPEYILDIHVYRVQLELDPNNAEAWYNLGNAYYRQGDYQRAIEYY
QRALELDPNNAEAWYNLGNAYYRQGDYQRAIEYYQRALELDPGGPRLPLG
DVSNNGGPNAEAWYNLGNAYYRQGDYQRAIEYYQRALELDPNN
(SEQ ID NO: 257)

3. Axin-RTPR-KEN
MGSGAYPEYILDIHVYRVQLELDPNNAEAWYNLGNAYYRQGDYQRAIEYY
QRALELDPNNAEAWYNLGNAYYRQGDYQRAIEYYQRALELDPGGPRLPLG
DVSNNGGPNAEAWYNLGNAYYRQGDYQRAIEYYQRALELDPNN
(SEQ ID NO: 258)

4. Axin-RTPR-Nrf2
MGSGAYPEYILDIHVYRVQLELDPNNAEAWYNLGNAYYRQGDYQRAIEYY
QRALELDPNNAEAWYNLGNAYYRQGDYQRAIEYYQRALELDPGGPRLPLG
DVSNNGGPNAEAWYNLGNAYYRQGDYQRAIEYYQRALELDPNN
(SEQ ID NO: 259)

5. Axin-RTPR-SIAH
MGSGAYPEYILDIHVYRVQLELDPNNAEAWYNLGNAYYRQGDYQRAIEYY
QRALELDPNNAEAWYNLGNAYYRQGDYQRAIEYYQRALELDPGGLRPVAM
VRPTVGGPNAEAWYNLGNAYYRQGDYQRAIEYYQRALELDPNN
(SEQ ID NO: 260)

6. Axin-RTPR-SPOP
MGSGAYPEYILDIHVYRVQLELDPNNAEAWYNLGNAYYRQGDYQRAIEYY
QRALELDPNNAEAWYNLGNAYYRQGDYQRAIEYYQRALELDPGGLACDEVTSTTSSTAGGPNAEAWYNLGNAYYRQGDYQRAI
EYYQRALELDPNN (SEQ ID NO: 261)

7. Axin-RTPR-p27
MGSGAYPEYILDIHVYRVQLELDPNNAEAWYNLGNAYYRQGDYQRAIEYY
QRALELDPNNAEAWYNLGNAYYRQGDYQRAIEYYQRALELDPNNAGSNEQ
EPKKRSPDAEAWYNLGNAYYRQGDYQRAIEYYQRALELDPNN
(SEQ ID NO: 262)

8. Axin-RTPR-p53
MGSGAYPEYILDIHVYRVQLELDPNNAEAWYNLGNAYYRQGDYQRAIEYY
QRALELDPNNAEAWYNLGNAYYRQGDYQRAIEYYQRALELDPNNFAAYWN
LLSAYG (SEQ ID NO: 263)

10. Bcl9-RTPR-ABBA
MGSSQEQLEHRYRSLITLYDIQLMLDPNNAEAWYNLGNAYYRQGDYQRAI
EYYQRALELDPNNAEAWYNLGNAYYRQGDYQRAIEYYQRALELDPGGDPE
TGELGGPNAEAWYNLGNAYYRQGDYQRAIEYYQRALELDPNN
(SEQ ID NO: 264)

11. Bcl9-RTPR-DBOX-v1
MGSSQEQLEHRYRSLITLYDIQLMLDPNNAEAWYNLGNAYYRQGDYQRAI
EYYQRALELDPNNAEAWYNLGNAYYRQGDYQRAIEYYQRALELDPGGPRL
PLGDVSNNGGPNAEAWYNLGNAYYRQGDYQRAIEYYQRALELDPNN
(SEQ ID NO: 265)

12. Bcl9-RTPR-DBOX-v2
MGSSQEQLEHRYRSLITLYDIQLMLDPNNAEAWYNLGNAYYRQGDYQRAI
EYYQRALELDPGGPRLPLGDVSNNGGPNAEAWYNLGNAYYRQGDYQRAIE
YYQRALELDPNN (SEQ ID NO: 266)

13. Bcl9-RTPR-KEN
MGSGAYPEYILDIHVYRVQLELDPNNAEAWYNLGNAYYRQGDYQRAIEYY
QRALELDPNNAEAWYNLGNAYYRQGDYQRAIEYYQRALELDPGGSLSSAF
HVFEDGNKENGGPNAEAWYNLGNAYYRQGDYQRAIEYYQRALELDPNN
(SEQ ID NO: 267)

TABLE 8-continued

14. Bcl9-RTPR-Nrf2
MGSSQEQLEHRYRSLITLYDIQLMLDPNNAEAWYNLGNAYYRQGDYQRAI
EYYQRALELDPNNAEAWYNLGNAYYRQGDYQRAIEYYQRALELDPGGDPE
TGELGGPNAEAWYNLGNAYYRQGDYQRAIEYYQRALELDPNN
(SEQ ID NO: 268)

15. Bcl9-RTPR-p27
MGSSQEQLEHRYRSLITLYDIQLMLDPNNAEAWYNLGNAYYRQGDYQRAI
EYYQRALELDPNNAEAWYNLGNAYYRQGDYQRAIEYYQRALELDPNNAGS
NEQEPKKRSPDAEAWYNLGNAYYRQGDYQRAIEYYQRALELDPNN
(SEQ ID NO: 269)

16. Bcl9-RTPR-p53
MGSSQEQLEHRYRSLITLYDIQLMLDPNNAEAWYNLGNAYYRQGDYQRAI
EYYQRALELDPNNAEAWYNLGNAYYRQGDYQRAIEYYQRALELDPNNFAA
YWNLLSAYG (SEQ ID NO: 270)

17. Bcl9-RTPR-SIAH
MGSSQEQLEHRYRSLITLYDIQLMLDPNNAEAWYNLGNAYYRQGDYQRAI
EYYQRALELDPNNAEAWYNLGNAYYRQGDYQRAIEYYQRALELDPGGLRP
VAMVRPTVGGPNAEAWYNLGNAYYRQGDYQRAIEYYQRALELDPNN
(SEQ ID NO: 271)

18. Bcl9-RTPR-SPOP
MGSSQEQLEHRYRSLITLYDIQLMLDPNNAEAWYNLGNAYYRQGDYQRAI
EYYQRALELDPGGLACDEVTSTTSSSTAGGPNAEAWYNLGNAYYRQGDYQ
RAIEYYQRALELDPNN (SEQ ID NO: 272)

19. TCF7L2-RTPR-Nrf2
MGSAEAWYNLGNAYYRQGDYQRAIEYYQRALELDPGGQELGDNDELMHFS
YESTQDGGPNAEAWYNLGNAYYRQGDYQRAIEYYQRALELDPNNAEAWYN
LGNAYYRQGDYQRAIEYYQRALELDPGGDPETGELGGPNAEAWYNLGNAY
YRQGDYQRAIEYYQRALELDPNN (SEQ ID NO: 273)

20. TCF7L2-RTPR-p27
MGSAEAWYNLGNAYYRQGDYQRAIEYYQRALELDPGGQELGDNDELMHFS
YESTQDGGPNAEAWYNLGNAYYRQGDYQRAIEYYQRALELDPNNAEAWYN
LGNAYYRQGDYQRAIEYYQRALELDPNNAGSNEQEPKKRSPDAEAWYNLG
NAYYRQGDYQRAIEYYQRALELDPNN (SEQ ID NO: 274)

21. p27-RTPR-TCF7L2
MRGSHHHHHHGLVPRGSAEAWYNLGNAYYRQGDYQRAIEYYQRALELDPN
NAGSNEQEPKKRSPDAEAWYNLGNAYYRQGDYQRAIEYYQRALELDPRSA
EAWYNLGNAYYRQGDYQRAIEYYQRALELDPGGQELGDNDELMHFSYEST
QDGGPNAEAWYNLGNAYYRQGDYQRAIEYYQRALELDPRS
(SEQ ID NO: 275)

22. TCF7L2-RTPR-p53
MGSAEAWYNLGNAYYRQGDYQRAIEYYQRALELDPGGQELGDNDELMHFS
YESTQDGGPNAEAWYNLGNAYYRQGDYQRAIEYYQRALELDPNNAEAWYN
LGNAYYRQGDYQRAIEYYQRALELDPNNFAAYWNLLSAYG
(SEQ ID NO: 276)

23. ICAT-RTPR-p27
MGSYAYQRAIVEYMLRLMSDPNNAEAWYNLGNAYYRQGDYQRAIEYYQRA
LELDPNNAEAWYNLGNAYYRQGDYQRAIEYYQRALELDPNNAGSNEQEPK
KRSPDAEAWYNLGNAYYRQGDYQRAIEYYQRALELDPNN
(SEQ ID NO: 277)

24. ICAT-RTPR-p53
MGSYAYQRAIVEYMLRLMSDPNNAEAWYNLGNAYYRQGDYQRAIEYYQRA
LELDPNNAEAWYNLGNAYYRQGDYQRAIEYYQRALELDPNNFAAYWNLLS
AYG (SEQ ID NO: 278)

25. LRH1-RTPR-ABBA
MGSYEQAIAAYLDALMCDPNNAEAWYNLGNAYYRQGDYQRAIEYYQRALE
LDPNNAEAWYNLGNAYYRQGDYQRAIEYYQRALELDPGGSEDKENVPPGG
PNAEAWYNLGNAYYRQGDYQRAIEYYQRALELDPNN (SEQ ID NO: 279)

26. LRH1-RTPR-DBOX
MGSYEQAIAAYLDALMCDPNNAEAWYNLGNAYYRQGDYQRAIEYYQRALE
LDPNNAEAWYNLGNAYYRQGDYQRAIEYYQRALELDPGGPRLPLGDVSNN
GGPNAEAWYNLGNAYYRQGDYQRAIEYYQRALELDPNN
(SEQ ID NO: 280)

27. LRH1-RTPR-KEN
MGSYEQAIAAYLDALMCDPNNAEAWYNLGNAYYRQGDYQRAIEYYQRALE
LDPNNAEAWYNLGNAYYRQGDYQRAIEYYQRALELDPGGSEDKENVPPGG
PNAEAWYNLGNAYYRQGDYQRAIEYYQRALELDPNN
(SEQ ID NO: 281)

28. LRH1-RTPR-Nrf2
MGSYEQAIAAYLDALMCDPNNAEAWYNLGNAYYRQGDYQRAIEYYQRALE
LDPNNAEAWYNLGNAYYRQGDYQRAIEYYQRALELDPGGDPETGELGGPN
AEAWYNLGNAYYRQGDYQRAIEYYQRALELDPNN (SEQ ID NO: 282)

29. LRH1-RTPR-p27
MGSYEQAIAAYLDALMCDPNNAEAWYNLGNAYYRQGDYQRAIEYYQRALE
LDPNNAEAWYNLGNAYYRQGDYQRAIEYYQRALELDPNNAGSNEQEPKKR
SPDAEAWYNLGNAYYRQGDYQRAIEYYQRALELDPNN
(SEQ ID NO: 283)

30. LRH1-RTPR-p53
MGSYEQAIAAYLDALMCDPNNAEAWYNLGNAYYRQGDYQRAIEYYQRALE
LDPNNAEAWYNLGNAYYRQGDYQRAIEYYQRALELDPNNFAAYWNLLS
AYG (SEQ ID NO: 284)

31. LRH1-RTPR-SIAH
MGSYEQAIAAYLDALMCDPNNAEAWYNLGNAYYRQGDYQRAIEYYQRALE
LDPNNAEAWYNLGNAYYRQGDYQRAIEYYQRALELDPGGLRPVAMVRPTV
GGPNAEAWYNLGNAYYRQGDYQRAIEYYQRALELDPNN
(SEQ ID NO: 285)

32. LRH1-RTPR-SPOP
MGSYEQAIAAYLDALMCDPNNAEAWYNLGNAYYRQGDYQRAIEYYQRALE
LDPNNAEAWYNLGNAYYRQGDYQRAIEYYQRALELDPGGLACDEVTSTTS
SSTAGGPNAEAWYNLGNAYYRQGDYQRAIEYYQRALELDPNN
(SEQ ID NO: 286)

33. APC-RTPR-Nrf2
MGSAEAWYNLGNAYYRQGDYQRAIEYYQRALELDPGGSCSEELEALEALE
LDEGGPNAEAWYNLGNAYYRQGDYQRAIEYYQRALELDPNNAEAWYNLGN
AYYRQGDYQRAIEYYQRALELDPGGDPETGELGGPNAEAWYNLGNAYYRQ
GDYQRAIEYYQRALELDPNN (SEQ ID NO: 287)

34. APC-RTPR-p27
MGSAEAWYNLGNAYYRQGDYQRAIEYYQRALELDPGGSCSEELEALEALE
LDEGGPNAEAWYNLGNAYYRQGDYQRAIEYYQRALELDPNN
(SEQ ID NO: 288)

35. p27-RTPR-APC
MRGSHHHHHHGLVPRGSAEAWYNLGNAYYRQGDYQRAIEYYQRALELDPN
NAGSNEQEPKKRSPDAEAWYNLGNAYYRQGDYQRAIEYYQRALELDPRSA
EAWYNLGNAYYRQGDYQRAIEYYQRALELDPGGSCSEELEALEALELDEG
GPNAEAWYNLGNAYYRQGDYQRAIEYYQRALELDPRS
(SEQ ID NO: 289)

36. APC-RTPR-p53
MGSAEAWYNLGNAYYRQGDYQRAIEYYQRALELDPGGQELGDNDELMHFS
YESTQDGGPNAEAWYNLGNAYYRQGDYQRAIEYYQRALELDPNNAEAWYN
LGNAYYRQGDYQRAIEYYQRALELDPNNFAAYWNLLSAYG
(SEQ ID NO: 290)

37. 1TBP-CTPR2
MGSAEAWYNLGNAYYKQGDYQKAIEYYQKALELDPNNREAGDGEEDPRSA
EAWYNLGNAYYKQGDYQKAIEYYQKALELDPRS (SEQ ID NO: 291)

38. 2TBP-CTPR4
MGSAEAWYNLGNAYYKQGDYQKAIEYYQKALELDPNNREAGDGEEDPRSA
EAWYNLGNAYYKQGDYQKAIEYYQKALELDPRSAEAWYNLGNAYYKQGDY
QKAIEYYQKALELDPNNREAGDGEEDPRSAEAWYNLGNAYYKQGDYQKAI
EYYQKALELDPRS (SEQ ID NO: 292)

39. 3TBP-CTPR6
MGSAEAWYNLGNAYYKQGDYQKAIEYYQKALELDPNNREAGDGEEDPRSA
EAWYNLGNAYYKQGDYQKAIEYYQKALELDPRSAEAWYNLGNAYYKQGDY
QKAIEYYQKALELDPNNREAGDGEEDPRSAEAWYNLGNAYYKQGDYQKAI
EYYQKALELDPRSAEAWYNLGNAYYKQGDYQKAIEYYQKALELDPNNREA
GDGEEDPRSAEAWYNLGNAYYKQGDYQKAIEYYQKALELDPRS
(SEQ ID NO: 293)

40. 4TBP-CTPR8
MGSAEAWYNLGNAYYKQGDYQKAIEYYQKALELDPNNREAGDGEEDPRSA
EAWYNLGNAYYKQGDYQKAIEYYQKALELDPRSAEAWYNLGNAYYKQGDY
QKAIEYYQKALELDPNNREAGDGEEDPRSAEAWYNLGNAYYKQGDYQKAI
EYYQKALELDPRSAEAWYNLGNAYYKQGDYQKAIEYYQKALELDPNNREA

TABLE 8-continued

GDGEEDPRSAEAWYNLGNAYYKQGDYQKAIEYYQKALELDPRSAEAWYNL
GNAYYKQGDYQKAIEYYQKALELDPNNREAGDGEEDPRSAEAWYNLGNAY
YKQGDYQKAIEYYQKALELDPRS (SEQ ID NO: 294)

41. 1TBP-CTPR2-Foldon (Foldon sequence in bold)
MGSAEAWYNLGNAYYKQGDYQKAIEYYQKALELDPNNREAGDGEEDPRSA
EAWYNLGNAYYKQGDYQKAIEYYQKALELDPRS**AKASLNLANADIKTIQE
AGYIPEAPRDGQAYVRKDGEWVLLSTFLRS** (SEQ ID NO: 295)

42. 2TBP-CTPR4-Foldon (Foldon sequence in bold)
MGSAEAWYNLGNAYYKQGDYQKAIEYYQKALELDPNNREAGDGEEDPRSA
EAWYNLGNAYYKQGDYQKAIEYYQKALELDPRSAEAWYNLGNAYYKQGDY
QKAIEYYQKALELDPNNREAGDGEEDPRSAEAWYNLGNAYYKQGDYQKAI
EYYQKALELDPRS**AKASLNLANADIKTIQEAGYIPEAPRDGQAYVRKDGE
WVLLSTFLRS** (SEQ ID NO: 296)

43. 3TBP-CTPR6-Foldon (Foldon sequence in bold)
MGSAEAWYNLGNAYYKQGDYQKAIEYYQKALELDPNNREAGDGEEDPRSA
EAWYNLGNAYYKQGDYQKAIEYYQKALELDPRSAEAWYNLGNAYYKQGDY
QKAIEYYQKALELDPRSAEAWYNLGNAYYKQGDYQKAIEYYQKALELDPNNREA
GDGEEDPRSAEAWYNLGNAYYKQGDYQKAIEYYQKALELDPRS**AKASLNL
ANADIKTIQEAGYIPEAPRDGQAYVRKDGEWVLLSTFLRS**
(SEQ ID NO: 297)

44. 4TBP-CTPR8-Foldon (Foldon sequence in bold)
MGSAEAWYNLGNAYYKQGDYQKAIEYYQKALELDPNNREAGDGEEDPRSA
EAWYNLGNAYYKQGDYQKAIEYYQKALELDPRSAEAWYNLGNAYYKQGDY
QKAIEYYQKALELDPNNREAGDGEEDPRSAEAWYNLGNAYYKQGDYQKAI
EYYQKALELDPRSAEAWYNLGNAYYKQGDYQKAIEYYQKALELDPNNREA
GDGEEDPRSAEAWYNLGNAYYKQGDYQKAIEYYQKALELDPRSAEAWYNL
GNAYYKQGDYQKAIEYYQKALELDPNNREAGDGEEDPRSAEAWYNLGNAY
YKQGDYQKAIEYYQKALELDPRS**AKASLNLANADIKTIQEAGYIPEAPRD
GQAYVRKDGEWVLLSTFLRS** (SEQ ID NO: 298)

45. KBL-RTPR-CMA_Q
MGSIPNPLLGLDGSAEAWYNLGNAYYRQGDYQRAIEYYQRALELDPNNPL
YISYDPAEAWYNLGNAYYRQGDYQRAIEYYQRALELDPRSAEAWYNLGNA
YYRQGDYQRAIEYYQRALELDPNNQRFFE (SEQ ID NO: 299)

46. CMA_Q-KBL-RTPR
MGSQRFFEGSAEAWYNLGNAYYRQGDYQRAIEYYQRALELDPNNPLYISY
DPAEAWYNLGNAYYRQGDYQRAIEYYQRALELDPRSAEAWYNLGNAYYRQ
GDYQRAIEYYQRALELDPNN (SEQ ID NO: 300)

47. CMA_K-KBL-RTPR
MGSKFERQGSAEAWYNLGNAYYRQGDYQRAIEYYQRALELDPNNPLYISY
DPAEAWYNLGNAYYRQGDYQRAIEYYQRALELDPRSAEAWYNLGNAYYRQ
GDYQRAIEYYQRALELDPNN (SEQ ID NO: 301)

48. SOS-RTPR-CMA_K
MGSFEGIALTNYLKALEGDPNNAEAWYNLGNAYYRQGDYQRAIEYYQRAL
ELDPNNAEAWYNLGNAYYRQGDYQRAIEYYQRALELDPRSKFERQ
(SEQ ID NO: 302)

49. SOS-RTPR-CMA_Q
MGSFEGIALTNYLKALEGDPNNAEAWYNLGNAYYRQGDYQRAIEYYQRAL
ELDPRSIPNPLLGLDKFERQ (SEQ ID NO: 303)

50. SOS-RTPR-p27
MGSFEGIALTNYLKALEGDPNNAEAWYNLGNAYYRQGDYQRAIEYYQRAL
ELDPNNAEAWYNLGNAYYRQGDYQRAIEYYQRALELDPRSAEAWYNLGNA
YYRQGDYQRAIEYYQRALELDPNNAGSNEQEPKKRSPDAEAWYNLGNAYY
RQGDYQRAIEYYQRALELDPRS (SEQ ID NO: 304)

51. KBL-RTPR-p27
MGSAEAWYNLGNAYYRQGDYQRAIEYYQRALELDPNNPLYISYDPAEAWY
NLGNAYYRQGDYQRAIEYYQRALELDPRSAEAWYNLGNAYYRQGDYQRAI
EYYQRALELDPNNAGSNEQEPKKRSAEAWYNLGNAYYRQGDYQRAIEYYQ
RALELDPNN (SEQ ID NO: 305)

Table 9 Alignment of TPR Repeat Sequences

| | | | | |
|---|---|---|---|---|
| S75991 | ALTLNNIGTI | YYAREDYDQA | LNYYEQALSL | SRAV | (SEQ ID NO:309) |
| 2407639-54 | AEELKEQANE | YFRVKDYDHA | VQYYTQAIDL | SPDT | (SEQ ID NO:310) |
| YDAB_MY | WRAWFRLGLA | YDGAGDRRRA | REAIRRAITL | EKNP | (SEQ ID NO:311) |
| GSIA_BA | SSALYNLGNC | YEKMGELQKA | AEYFGKSVSI | CKSE | (SEQ ID NO:312) |
| E64417 | VPMWVKKAEI | LRKLGRYEDA | LLCLNRALEL | KPHD | (SEQ ID NO:313) |
| A56519 | EPLLNNLGHV | CRKLKKYAEA | LDYHRQALVL | IPQN | (SEQ ID NO:314) |
| DMUNKNOWN_1-96 | EKVYFNLGML | AMDESSFDEA | EQFFKRAIHL | KADF | (SEQ ID NO:315) |
| SPAC6B12_12-516 | SEVYNYFGEI | LLDQQKFDDA | VKNFDHAIEL | EKRE | (SEQ ID NO:316) |
| NUC2_SC | PESWCILANC | FSLQREHSQA | LKCINRAIQL | DPTF | (SEQ ID NO:317) |
| CELZK320 | ARICNLQAEL | LYRRREFSQA | VDICKQALAY | HETD | (SEQ ID NO:318) |
| NFRA_EC | ANAYVARATI | YRQRHNVPAA | VSDLRAALEL | EPNN | (SEQ ID NO:319) |
| CCU2886 | GLAWHILAIA | REKTGDFASS | LRAYEAALAL | LPDH | (SEQ ID NO:320) |
| S766850 | FELHYHLANA | YRRQQKWELA | RKHYQKALDE | EILL | (SEQ ID NO:321) |
| CELT19A | VAIHFTLGNI | YASIGDYQRA | LNFYYSTLSL | QANF | (SEQ ID NO:322) |
| S766851 | AEAYQNLAVT | SFKAGLIQES | VDAFQQAIAL | YEQR | (SEQ ID NO:323) |
| S75601 | YKGWYQQGNT | LWQQGKYNDA | LLSYERALEY | YPGD | (SEQ ID NO:324) |
| YHBM_EC | PEVFNYLGIY | LTQAGNFDAA | YEAFDSVLEL | DPTY | (SEQ ID NO:325) |
| HSU4203 | EKGLYRRGEA | QLLMNEFESA | KGDFEKVLEV | NPQN | (SEQ ID NO:326) |
| YKD1_CA | ADLRVGIGHC | FAKMGMMDKA | KTAFERAMEI | EPYN | (SEQ ID NO:327) |
| CELZK32 | PGSYSLLGDA | FMKVQEPEDA | INFYEQALKM | QSKD | (SEQ ID NO:328) |
| S56658 | SKGYTRKGAV | QFSMKEYDKA | LETYREGLKH | DPNN | (SEQ ID NO:329) |
| G02540 | AQSCYSLGNT | YTLLQDYEKA | IDYHLKHLAI | AQEL | (SEQ ID NO:330) |
| CELC55B | ADILCERAEA | HILDEDYDSA | IEDYQKATEV | NPDH | (SEQ ID NO:331) |
| CELF30H | PVLYRNRAMA | RLKRDDFEGA | QSDCTKALEF | DGAD | (SEQ ID NO:332) |
| B55508 | VESTSLLGLV | YKLKGQEKNA | LFYYEKALRL | TGEM | (SEQ ID NO:333) |
| SMU5458 | TDCLYHLAVG | FLKLNDYHNA | TIYCQCLLTI | EPDN | (SEQ ID NO:334) |
| BSTHRZ1 | GRTLYNIGLC | KNSQSQYEDA | IPYFKRAIAV | FEES | (SEQ ID NO:335) |
| PSEPILF | SRVFENLGLV | SLQMKKPAQA | KEYFEKSLRL | NRNQ | (SEQ ID NO:336) |
| CELF38B0 | AVAWMNLGIS | QMNLKKYYEA | EKSLKNSLLI | RPNS | (SEQ ID NO:337) |
| JT06030 | PETHYNRGLA | WERLGNVDQA | IADYGRSIAL | DRYY | (SEQ ID NO:338) |
| JT06031 | YKAYYNRANS | YFQLGQYAQA | IADYNRVLVL | RPDY | (SEQ ID NO:339) |
| S76422 | AEAYYQRGLS | HYRLEDWAEA | VRDCTEAIRL | RGDL | (SEQ ID NO:340) |
| CC23_YE0 | RRIWQVLGEC | YSKTGNKVEA | IKCYKRSIKA | SQTV | (SEQ ID NO:341) |
| CELF38B1 | AHCLFNLGVL | YQRTNRDEMA | MSAWKNATRI | DPSH | (SEQ ID NO:342) |
| CC23_YE1 | PETCCIIANY | YSARQEHEKS | IMYFRRALTL | DKKT | (SEQ ID NO:343) |
| CELF38B2 | EQALNNLGNL | LEKSGDSKTA | ESLLARAVTL | RPSF | (SEQ ID NO:344) |
| MEU8731 | FEAWAALGKL | YLAQDDKGRA | LDAFRRAEAL | YPQW | (SEQ ID NO:345) |
| CELF38B3 | IQVLLGVAKC | WMIQKELDKA | LESIEKAQEL | AEGL | (SEQ ID NO:346) |
| S75615 | AEAYKARGKI | YWQLGEQAQA | IADLEAALAL | FSDQ | (SEQ ID NO:347) |
| CELF38B4 | VLFHANLGIL | YQRMSRHKEA | ESQYRIVLAL | DSKN | (SEQ ID NO:348) |
| CC27_YE0 | YNAYYGLGTS | AMKLGQYEEA | LLYFEKARSI | NPVN | (SEQ ID NO:349) |
| S74806 | AEVWLSRGLL | LEAMERKEEA | IPSYEKALTL | EPTL | (SEQ ID NO:350) |
| CELF38B5 | SRVHMQIGSC | HAKHSNFTAA | ENHIKSAIDL | NPTS | (SEQ ID NO:351) |
| CC27_YE1 | AYAYTLQGHE | HSSNDSSDSA | KTCYRKALAC | DPQH | (SEQ ID NO:352) |
| CELC56C | VEALRQKGNE | LFVQKDYKEA | IDAYRDALTR | LDTL | (SEQ ID NO:353) |
| F643990 | IDLILKVAFT | YFKLKKYKHA | LKYFEKALKL | NPNV | (SEQ ID NO:354) |
| F643991 | WKLWKNLGDK | AYLWKAYYEA | LFCYNKALEL | NQNT | (SEQ ID NO:355) |
| MTC1_CO | AEFYFRLGES | YFAHHQYTFA | VSYLEQAIDL | FENN | (SEQ ID NO:356) |
| MM284231_1-255 | TEAFYKISTL | YYQLGDHELS | LSEVRECLKL | DQDH | (SEQ ID NO:357) |
| F643992 | TELLCKKGYA | LLKLYKRDLA | IKYFEKASEK | DRNN | (SEQ ID NO:358) |
| KNLC_CA | AKQLNNLALL | CQNQGKYEEV | EKYYKRALEI | YESK | (SEQ ID NO:359) |
| ATAF0 | AQCFMHRASA | YRSAGRIAES | IADCNKTLAL | DPSC | (SEQ ID NO:360) |
| S585440 | VKAFYRRALA | HKGLKNYQKS | LIDLNKVILL | DPSI | (SEQ ID NO:361) |
| S585441 | LSIIFNRAAC | YLKEGNCSGC | IQDCNRALEL | HPFS | (SEQ ID NO:362) |
| A645120 | AVILSNIAKS | LYSRGLTNKV | IEVYNKAIKI | AEES | (SEQ ID NO:363) |
| A645121 | CEAFLNLAKA | YERLADFTKA | LQYGKASLEH | PSMD | (SEQ ID NO:364) |
| AB001 | AMSHMNIGIC | YDELKEYKK | QHLILALEI | FEKS | (SEQ ID NO:365) |
| I49564 | PSALTNKGNT | VFANGDYEK | FYKEALRN | DSSC | (SEQ ID NO:366) |

| | | | | |
|---|---|---|---|---|
| OM70_NE | PDIYYHRAQL | HFIKGEFAEA | AKDYQKSIDL | DSDF | (SEQ ID NO:367) |
| ATU6213 | AEAYCNMGVI | YKNRGDLEMA | ITCYERCLAV | SPNF | (SEQ ID NO:368) |
| S75709 | PAVWSNRGNS | RVSQNKLDEA | IADFNQAIEL | APEQ | (SEQ ID NO:369) |
| CELF32A | GRCYGSLGNT | YYCLGDYDQS | IHFHKLRLEL | SQQY | (SEQ ID NO:370) |
| CELT09B0 | AEQHNTNGKK | CYMNKRYDDA | VDHYSKAIKV | NPLP | (SEQ ID NO:371) |
| CELT09B1 | VKPLYFLGNV | FLQSKKYSEA | ISCLSKALYH | NAVI | (SEQ ID NO:372) |
| YCF3_OD | SYTLYNIGLI | YGNNGNYSQA | LEYYHQALEL | NSNL | (SEQ ID NO:373) |
| YHR7_YE | PPTYYHRGQM | YFILQDYKNA | KEDFQKAQSL | NPEN | (SEQ ID NO:374) |
| SSN6_YE | PIFWCSIGVL | YYQISQYRDA | LDAYTRAIRL | NPYI | (SEQ ID NO:375) |
| FLBA_CAUCR-226 | AVLWNTLGTV | LCNIGDAAGS | IVFFDESLRL | APDF | (SEQ ID NO:376) |
| BIMA_EM | YNAWYGLGTV | YDKMGKLDFA | EQHFRNAAKI | NPSN | (SEQ ID NO:377) |
| CUT9_SC0 | ASMCYLRGQV | YTNLSNFDRA | KECYKEALMV | DAKC | (SEQ ID NO:378) |
| CC27_HU | YNAWYGLGMI | YYKQEKFSLA | EMHFQKALDI | NPQS | (SEQ ID NO:379) |
| MMUTY0 | AAFLYGLGLV | YFYYNAFQWA | IRAFQEVLYV | DPNF | (SEQ ID NO:380) |
| KNLC_ST | AKTKNNLAAA | YLKQGKYKAA | ETLYKQVLTR | AHER | (SEQ ID NO:381) |
| S757090 | AFAYNNRGNA | EGGLGNWTSA | LEDFQQATAI | APNF | (SEQ ID NO:382) |
| C48583 | VKAYLRRGIA | YEGMEKWKLA | LEDYTKAQSI | SPGV | (SEQ ID NO:383) |
| S757091 | TDPYLNRGTA | LEAKGEFKAA | IADYNRVLAV | NPED | (SEQ ID NO:384) |
| S759910 | GTSLSNIGLA | YNNLGEREKA | LEYYQEALTM | SRSV | (SEQ ID NO:385) |
| S566581 | ISYLTNRAAV | YLEMGKFEDC | IKDCEKAVER | GKEL | (SEQ ID NO:386) |
| S759911 | GAILSNIGYV | YDGLGELNQA | MDYYQQALVL | RREI | (SEQ ID NO:387) |
| S566582 | ADEAREKGNE | LFKQQKYPEA | TKHYTEAIKR | NPKD | (SEQ ID NO:388) |
| LMU73840 | VKGYARKGHA | YFWTKQYNRA | LQAYDEGLKV | DPSN | (SEQ ID NO:389) |
| S759912 | VFALNRLGTI | YSDFGEKSQA | LAYYEQAIPL | AQQL | (SEQ ID NO:390) |
| S566583 | AQKEKEAGNA | AYKKKDFETA | IGHYSKALEL | DDED | (SEQ ID NO:391) |
| LMU73841 | HTSYSNRAAA | YIKLGAFNDA | LKDAEKCIEL | KPDF | (SEQ ID NO:392) |
| S759913 | GIRLNNIALL | YDSVGEKDEA | LTYYKEALKI | SQET | (SEQ ID NO:393) |
| LMU73842 | ATELKNKGNE | EFSAGRYVEA | VNYFSKAIQL | DEQN | (SEQ ID NO:394) |
| S759914 | MTTINNLGVA | YDNLGESEKA | LQYYAEALAL | GKSL | (SEQ ID NO:395) |
| TPRD_HU | GELMKMKGNE | EFSKERFDIA | IIYYTRAIEY | RPEN | (SEQ ID NO:396) |
| LMU73843 | ALALKEEGNK | LYLSKKFEEA | LTKYQEAQVK | DPNN | (SEQ ID NO:397) |
| S759915 | GSVISNIALV | LDGLGQKAQA | LEYYQQALEL | ARLV | (SEQ ID NO:398) |
| S60905 | IEYLYEKAQL | YRRLKDKENE | LKYYNLALSI | DENK | (SEQ ID NO:399) |
| YHBM_HA | ASVYNYLGLY | LLLEEDYDGA | LDAFNTVFEL | DSGY | (SEQ ID NO:400) |
| S759916 | GATLNNIGSI | YNALADRKKA | IDFYQQALVL | IRQA | (SEQ ID NO:401) |
| LMU73844 | AKQKKDEGNQ | YFKEDKFPEA | VAAYTEAIKR | NPAE | (SEQ ID NO:402) |
| S75633 | ASSLNNLGYL | AFLQGDLPTA | LDYYQRALIL | RQTT | (SEQ ID NO:403) |
| CET12D8 | AMLHAKRANV | LLKLKRPVAA | IADCDKAISI | NPDS | (SEQ ID NO:404) |
| S58544 | CAIYTNRALC | YLKLCQFEEA | KQDCDQALQL | ADGN | (SEQ ID NO:405) |
| C485830 | AVYYTNRAAC | HQQTHMYSLM | VDDCNAAIEI | DPAN | (SEQ ID NO:406) |
| BSZ9404 | WSAYNNLALA | YFYSGNVVKA | KQTAYEVLSH | NEGN | (SEQ ID NO:407) |
| Y366_HA | AKARVELALS | YLQQNNPQLA | KINLDKALQH | DKNY | (SEQ ID NO:408) |
| C485831 | PEEAKQLGNS | FFKDGKYDQA | AEFYTRAIEL | QTEP | (SEQ ID NO:409) |
| NPRA_BA0 | AECHILLGIC | YRRYGEVDQA | IECYSLAHKI | AQII | (SEQ ID NO:410) |
| YC37_PO | AKLYNMLGFI | YYKADQKKLA | KNFYERAIEV | DGNY | (SEQ ID NO:411) |
| N358_HU | PKAHRFLGLL | YELEENTDKA | VECYRRSVEL | NPTQ | (SEQ ID NO:412) |
| S42210 | TDVLRSAARF | YYKTHDKDRA | IQLLSQALEL | LPNN | (SEQ ID NO:413) |
| CC27_YE | PETWCCIGNL | LSLQKDHDAA | IKAFEKATQL | DPNF | (SEQ ID NO:414) |
| HIBN_XE0 | AQAHQKLGEV | CIESENYSQA | VEDFLACLNI | QKEH | (SEQ ID NO:415) |
| STI1_YE0 | ARGYSNRAAA | LAKLMSFPEA | IADCNKAIEK | DPNF | (SEQ ID NO:416) |
| STI1_YE1 | ADEYKQQGNA | AFTAKDYDKA | IELFTKAIEV | SETP | (SEQ ID NO:417) |
| CELF32A0 | AQMAYSLANA | LYIGKEVQKA | ITYFQRHLKI | ARSL | (SEQ ID NO:418) |
| STI1_YE2 | SKSFARIGNA | YHKLGDLKKT | IEYYQKSLTE | HRTA | (SEQ ID NO:419) |
| LACALS | ISIYQRIGDS | YAQLGNFENA | ISFLEKSLEF | DEKP | (SEQ ID NO:420) |
| CELR05F | SKAWGRMGLA | YSCQNRYEHA | AEAYKKALEL | EPNQ | (SEQ ID NO:421) |
| G025400 | AKASGNLGNT | LKVLGNFDEA | IVCCQRHLDI | SREL | (SEQ ID NO:422) |
| G025401 | RRAYSNLGNA | YIFLGEFETA | SEYYKKTLLL | ARQL | (SEQ ID NO:423) |
| H64467 | PLLYLKGII | LNKLGKYNEA | IKYFDKVLEI | NPNI | (SEQ ID NO:424) |
| G025402 | SAIYSQLGNA | YFYLHDYAKA | LEYHHDLTL | ARTI | (SEQ ID NO:425) |
| G025403 | GRACWSLGNA | YTALGNHDQA | MHFAEKHLEI | SREV | (SEQ ID NO:426) |
| PTSR_HU0 | YLLWNKLGAT | LANGNQSEE | AYRRALEL | QPGY | (SEQ ID NO:427) |

| | | | | |
|---|---|---|---|---|
| G025404 | GRAFGNLGNT | HYLLGNFRDA | VIAHEQRLLI | AKEF | (SEQ ID NO:428) |
| PTSR_HU1 | IRSRYNLGIS | CINLGAHREA | VEHFLEALNM | QRKS | (SEQ ID NO:429) |
| G025405 | TKQQIEKGLQ | LYQANETGKA | LEIWQQVVER | STEL | (SEQ ID NO:430) |
| YCA1_PL0 | PKGYIRKGCA | EHGLRQLSNA | EKTYLEGLKI | DPNN | (SEQ ID NO:431) |
| PQ01800 | PETWLNRGLA | YYRQGQSQAA | IADFDQLLQQ | SPTD | (SEQ ID NO:432) |
| CEC34C61 | VRARYNLGIS | CMQLSSYDEA | LKHFLSALEL | QKGG | (SEQ ID NO:433) |
| CEC34C62 | PDLQNALGVL | YNLNRNFARA | VDSLKLAISK | NPTD | (SEQ ID NO:434) |
| SSD900_122-109 | ADAYYNRGYA | KHVLGQYQAA | ITDYNQAISL | NPEF | (SEQ ID NO:435) |
| STI1_YE | SKGYNRLGAA | HLGLGDLDEA | ESNYKKALEL | DASN | (SEQ ID NO:436) |
| YCV0_YE | PVGYSNKAMA | LIKLGEYTQA | IQMCQQGLRY | TSTA | (SEQ ID NO:437) |
| HSAB2370_1-631 | FNCWESLGEA | YLSRGGYTTA | LKSFTKASEL | NPES | (SEQ ID NO:438) |
| S75648 | ADAYNLRGVA | YMVIEQYTDA | LADFDQAIAL | NPKD | (SEQ ID NO:439) |
| CELT19A0 | PLFHYVQGRM | KLLLHDVDKA | IQHLKDAMDK | DPNN | (SEQ ID NO:440) |
| CELT25F0 | FEGNYNLGLV | SFTQGKYHEC | RELIEKALAA | FPEH | (SEQ ID NO:441) |
| CEF10B5 | HPMLNNIGHI | ARRQGRLNEA | IMFYQKAIRM | EPKF | (SEQ ID NO:442) |
| CELT25F1 | VTMLTGMARV | QEALGEYDES | VKLYKRVLDA | ESNN | (SEQ ID NO:443) |
| BSAB617_17-292 | VQAVFSLTHI | YCKEGKYDKA | VEAYDRGIKS | AAEW | (SEQ ID NO:444) |
| CEM720 | ATMLNVLAIV | YRNQENFKDA | AIYLEKALSI | RVQC | (SEQ ID NO:445) |
| YCV0_YE0 | FEKQKEQGNS | LFKQGLYREA | VHCYDQLITA | QPQN | (SEQ ID NO:446) |
| YCV0_YE1 | AMSQYHMAVA | YRLLGRLGSA | MECCEESMKI | ALQH | (SEQ ID NO:447) |
| CELC55B0 | YQAIYRRATT | YLAMGRGKAA | IVDLERVLEL | KPDF | (SEQ ID NO:448) |
| CELC55B1 | YGARIQRGNI | LLKQGELEAA | EADFNIVLNH | DSSN | (SEQ ID NO:449) |
| HSU46570 | AKLYCNRGTV | NSKLRKLDDA | IEDCTNAVKL | DDTY | (SEQ ID NO:450) |
| HSU46571 | SILFSNRAAA | RMKQDKKEMA | INDCSKAIQL | NPSY | (SEQ ID NO:451) |
| BSU5504 | TKGLLNLGNC | FNKQDDVAKA | TVYYQRALEL | GEKI | (SEQ ID NO:452) |
| HSU46572 | ADALYVRGLC | LYYEDCIEKA | VQFFVQALRM | APDH | (SEQ ID NO:453) |
| HSU46573 | IRAILRRAEL | YEKTDKLDEA | LEDYKSILEK | DPSI | (SEQ ID NO:454) |
| HSU46574 | IKAYLRRAQC | YMDTEQYEEA | VRDYEKVYQT | EKTK | (SEQ ID NO:455) |
| LJGLN12 | ASACNNLAEF | YRIRKEFDKA | EPLYLEAINI | LEES | (SEQ ID NO:456) |
| HSU46575 | LKAKKEDGNK | AFKEGNYKLA | YELYTEALGI | DPNN | (SEQ ID NO:457) |
| D504537 | GRAYYNLGLC | YYNQDLLDPA | IDYFEKAVST | FESS | (SEQ ID NO:458) |
| MMUTY | ADTWCSIGVL | YQQQNQPMDA | LQAYICAVQL | DHGH | (SEQ ID NO:459) |
| CELD2020 | SAAWTDLGEL | YEKNAQYQDA | LECFKNAMLN | NPVA | (SEQ ID NO:460) |
| HSU46576 | STRLKEEGNE | QFKKGDYIEA | ESSYSRALEM | CPSC | (SEQ ID NO:461) |
| YB05_YE | ESLYANRAAC | ELELKNYRRC | IEDCSKALTI | NPKN | (SEQ ID NO:462) |
| HUMFKBP0 | VKCLNNLAAS | QLKLDHYRAA | LRSCSLVLEH | QPDN | (SEQ ID NO:463) |
| HSU46577 | ASYYGNRAAT | LMMLGRFREA | LGDAQQSVRL | DDSF | (SEQ ID NO:464) |
| CEM72 | AKQLTNLGIV | TQQLEKYEET | ENYFKQALSI | YNRA | (SEQ ID NO:465) |
| S75578 | SYILYNMALI | HASNGDHEKA | LGLYQEAIEL | NPKM | (SEQ ID NO:466) |
| PSEPILF0 | RDAYIQLGLG | YLQRGNTEQA | KVPLRKALEI | DPSS | (SEQ ID NO:467) |
| S450640 | AKSCANLGNI | FKMKGAYNDA | LTFTFKQLDF | AEEL | (SEQ ID NO:468) |
| BBCDG5 | ARFFNLIGLE | FFKLGQYGPA | IEYFAKNLEI | NPNN | (SEQ ID NO:469) |
| I40554 | AKALLNLGDS | YKNMGDQDRA | LYFLIKAVDQ | AKES | (SEQ ID NO:470) |
| ACU89981 | SRAFHRKGNA | YMKMEKYAEA | IDSYNRALTE | HRNP | (SEQ ID NO:471) |
| HSU20361 | IKIMQNIGVT | FIQAGQYSDA | INSYEHIMSM | APNL | (SEQ ID NO:472) |
| S668420 | EDVQLNLAHC | YLEMREYGKA | IENYELVLKK | FDNE | (SEQ ID NO:473) |
| HSU20362 | GQSWYFLGRC | YSCIGKVQDA | FVSYRQSIDK | SEAS | (SEQ ID NO:474) |
| ACU89983 | ALEEKNKGNA | AMSAGDFKAA | VEHYTNAIQH | DPQN | (SEQ ID NO:475) |
| S748530 | WPALNNIGLI | EYEQGKIDTA | LKRWQEVIKI | DSEQ | (SEQ ID NO:476) |
| HSU20363 | CRVCCSLGSF | YAQVKDYEKA | LFFPCKAAEL | VNNY | (SEQ ID NO:477) |
| ACU89984 | SKGYSRKGAA | LCYLGRYADA | KAAYAAGLEV | EPTN | (SEQ ID NO:478) |
| S748531 | AGIKFTLGNA | YFQKGQYDQA | VEVLLAGLAQ | RPDT | (SEQ ID NO:479) |
| ACU89985 | SQQEKEKGND | CFRNAQYPDA | IKHYTEAIRR | NPTD | (SEQ ID NO:480) |
| D63875 | AEVRLGMGHC | FVKLNKLEKA | RLAFSRALEL | NSKC | (SEQ ID NO:481) |
| ACU89986 | MTYLTNLAAV | YMEQKNYEEC | VNTCTEAIEV | GRRV | (SEQ ID NO:482) |
| YCOA_SY | TVALTALGLA | ARAIGNYPEA | IAAYQQALQL | DPND | (SEQ ID NO:483) |
| D644170 | PVAYALLGQL | YELLGNFDNA | LECYEKSLGI | EEKF | (SEQ ID NO:484) |
| YCIM_HA | VRASLLLANL | AMLDGQYQQA | VKILENVLEQ | NPDY | (SEQ ID NO:485) |
| D644171 | IPAYIIKANM | LRKLGRYEEA | LACVNKVLEL | KEND | (SEQ ID NO:486) |
| YLU28151 | AEAWGRLGAC | QAQNEKEDPA | IRALERCIKL | EPGN | (SEQ ID NO:487) |
| S74853 | PAALFDLGNA | YLKLVKYPD | AYQKALKA | EEQF | (SEQ ID NO:488) |

| | | | |
|---|---|---|---|
| HGV2_HA | AETYYNLGLA | YSFEKRYDNA | LEHYQSALDV LEAR | (SEQ ID NO:489) |
| CELR05F0 | PVYFCNRAAA | YCRLEQYDLA | IQDCRTALAL DPSY | (SEQ ID NO:490) |
| YC37_CY | ALIYNSLGYI | CSAQEQYELA | IEYYKKALFY IPDF | (SEQ ID NO:491) |
| NCF2_HU | AVAYFQRGML | YYQTEKYDLA | IKDLKEALIQ LRGN | (SEQ ID NO:492) |
| HUMFKBP | IKALFRKGKV | LAQQGEYSEA | IPILRAALKL EPSN | (SEQ ID NO:493) |
| JC47510 | VAVRLNLGLT | YLKLCKPDKC | IEFCRKVLDV FGNN | (SEQ ID NO:494) |
| I40567 | AKALLNMGNS | YNQMGSLFSA | VPYYHKAIKA AKIS | (SEQ ID NO:495) |
| CEZK856 | AIAYQQIATV | YEQLGDHQKA | LQFGLLASHL DPKT | (SEQ ID NO:496) |
| S756480 | PAIYFNRANV | HGVLNNYQGA | IDDCSQGILL DPQD | (SEQ ID NO:497) |
| S756481 | EEAHYFRGLA | YAMVNNYERA | LADLNRTIRL NPYN | (SEQ ID NO:498) |
| LEPLIPL | WGAKANLATY | YFSAGDFEKS | IKLYEEAMKL KDAD | (SEQ ID NO:499) |
| S756482 | VDLLICRGQA | QLGLEQPRQA | IPDFDRAIEL DPRS | (SEQ ID NO:500) |
| CUT9_SC | AATWANLGHA | YRKLKMYDAA | IDALNQGLLL STND | (SEQ ID NO:501) |
| PS43_TO0 | AHVLLNIAKC | WMTEKKLDKT | LGVVQKAEEL ADAV | (SEQ ID NO:502) |
| RNU76551 | ADSLNNLANI | KREQGNIEEA | VRLYRKALEV FPEF | (SEQ ID NO:503) |
| S66842 | PDPRIGIGLC | FWQLKDSKMA | IKSWQRALQL NPKN | (SEQ ID NO:504) |
| HSU58970 | SVLYSNRAAC | HWKNGNCRDC | IKDCTSALAL VPFS | (SEQ ID NO:505) |
| RNU76552 | PDAYCNLANA | LKEKGSVAEA | EDCYNTALRL CPTH | (SEQ ID NO:506) |
| JC4751 | EKALFRMGQA | HLLRNDHDEA | LVYFKKIVAK NPNN | (SEQ ID NO:507) |
| HSU58971 | IKPLLRRASA | YEALEKYPMA | YVDYKTVLQI DDNV | (SEQ ID NO:508) |
| RNU76553 | YCVRSDLGNL | LKALGRLEEA | KACYLKAIET QPNF | (SEQ ID NO:509) |
| HSU58972 | VKAFYRRAQA | HKALKDYKSS | FADISNLLQI EPRN | (SEQ ID NO:510) |
| RNU76554 | LDAYINLGNV | LKEARIFDRA | VAAYLRALSL SPNH | (SEQ ID NO:511) |
| YQGP_BA | HASYYNLALL | YAEKNELAQA | EKAIQTAVKL KPKE | (SEQ ID NO:512) |
| D907664 | ARVSIMMGRV | FMAKGEYAKA | VESLQRVISQ DREL | (SEQ ID NO:513) |
| AB0010 | GKYYKEIAEL | YELEQNFEQA | IIYFEKAADI YQSE | (SEQ ID NO:514) |
| KNLC_HU | AATLNNLAVL | YGKRGKYKEA | EPLCKRALEI REKV | (SEQ ID NO:515) |
| S756010 | FWSWYRQADC | FRRWGHYAEA | LQCYKKSLEI RPND | (SEQ ID NO:516) |
| G02058 | VQSLSALGFV | YKLEGEKRQA | AEYYEKAQKI DPEN | (SEQ ID NO:517) |
| YQCH_BA0 | PQAYHDLALI | YFKQGKKGQA | MDCFRKGIRS AVDF | (SEQ ID NO:518) |
| S756011 | YWAWYKRGIT | LEHLGRYRDA | AESYDNACQI QPEN | (SEQ ID NO:519) |
| S756012 | YWATYRLGES | YRLSGQYEAA | IASFRQTLTI RQDD | (SEQ ID NO:520) |
| S760710 | VIALNNLANV | YEKKQMVNKA | LETYQETLAI EPNN | (SEQ ID NO:521) |
| CC23_YE | TNAWTLMGHE | FVELSNSHAA | IECYRRAVDI CPRD | (SEQ ID NO:522) |
| S756013 | YWAWFRQGEL | WQQIYRYGRA | IACYHRALDV EVDD | (SEQ ID NO:523) |
| S760711 | AQEYYQLGSI | YLDKKLYSQS | INLFQKALKM AEQV | (SEQ ID NO:524) |
| CEC34C6 | ARAWCKLGLA | HAENEKDQLA | MQAFQKCLQI DAGN | (SEQ ID NO:525) |
| PTSR_PI0 | VDAWLKLGEV | QTQNEKESDG | IAALEKCLEL DPTN | (SEQ ID NO:526) |
| PTSR_PI1 | VRARYNLGVS | FINMGRYKEA | VEHLLTGISL HEVE | (SEQ ID NO:527) |
| INI6_HU | LESLSLLGFV | YKLEGNMNEA | LEYYERALRL AADF | (SEQ ID NO:528) |
| S75202 | AELFGSMGYL | YARQGQFAEA | SRSFQQALRV NPNN | (SEQ ID NO:529) |
| YO91_CA | ARAHRSLGHL | LLMDKKFEEA | YKHLRRSLEL QPIQ | (SEQ ID NO:530) |
| CC16_YE0 | ISIQLNLGHT | YRKLNENEIA | IKCFRCVLEK NDKN | (SEQ ID NO:531) |
| CC16_YE1 | PLVLNEMGVM | YFKKNEFVKA | KKYLKKALEV VKDL | (SEQ ID NO:532) |
| CC16_YE2 | SSLCFLRGKI | YFAQNNFNKA | RDAFREAILV DIKN | (SEQ ID NO:533) |
| CC16_YE3 | AITWFSVATY | YMSLDRISEA | QKYYSKSSIL DPSF | (SEQ ID NO:534) |
| ACSC_AC | ADSLGGMGLV | SMRQGDTAEA | RRYFEEAMAA DPKT | (SEQ ID NO:535) |
| HSU5251 | TDVLRSAAKF | YRRKGDLDKA | IELFQRVLES TPNN | (SEQ ID NO:536) |
| CC16_YE4 | TEGYLNLARS | NEKLCEFQKT | ISYCKTCLNM QGTT | (SEQ ID NO:537) |
| NCU89985_1-41 | AIAFKNEGNK | AFAAHDWPKA | IEFYDKAIEL NDKE | (SEQ ID NO:538) |
| CC16_YE5 | AAAWLGFAHT | YALEGEQDQA | LTAYSTASRF FPGM | (SEQ ID NO:539) |
| CYP6_YE | AKALYRRGLA | YYHVNDTDMA | LNDLEMATTF QPND | (SEQ ID NO:540) |
| D638750 | VDCYLRLGAM | ARDKGNFYEA | SDWFKEALQI NQDH | (SEQ ID NO:541) |
| S75685 | AQAHCLLGMA | YLKNNMMTMA | KVHIGSAVKL DPND | (SEQ ID NO:542) |
| S76576 | PQLFYGWGLL | ETSKGNYQSA | LNHYDQALAL DPEF | (SEQ ID NO:543) |
| D638751 | VLPFFGLGQM | YIYRGDKENA | SQCFEKVLKA YPNN | (SEQ ID NO:544) |
| D638752 | IPALLGKACI | SFNKKDYRGA | LAYYKKAIRT NPGC | (SEQ ID NO:545) |
| H644670 | AIAWAEKGEI | LYREGKLKKS | LECFDNALKI NPKD | (SEQ ID NO:546) |
| RLU3940 | GRAYRELGFV | ALYRRRFDES | LEYFQQAQDL NPND | (SEQ ID NO:547) |
| H644671 | PDVYVRKARI | LRTLGENDKA | LEYFDKALKL KPKY | (SEQ ID NO:548) |
| MMU1695 | LAAFLNLAMC | YLKLREYNK | CCDKALGL DSAN | (SEQ ID NO:549) |

| | | | | |
|---|---|---|---|---|
| D638753 | AESCYQLARS | FHVQEDYDQA | FQYYYQATQF | ASSS | (SEQ ID NO:550) |
| I495640 | GRLKVNMGNI | YLKQRNYSKA | IKFYRMALDQ | IPSV | (SEQ ID NO:551) |
| OM70_NE0 | ALAYNLRGTF | HCLMGKHEEA | LADLSKSIEL | DPAM | (SEQ ID NO:552) |
| H644672 | CQSLLYKGEI | LFKLGRYGEA | LKCLKKVFER | NNKD | (SEQ ID NO:553) |
| D638754 | SDVWLNLAHI | YVEQKQYISA | VQMYENCLRK | FYKH | (SEQ ID NO:554) |
| I495641 | AQVLCQIANI | YELMEDPNQA | IEWLMQLISV | VPTD | (SEQ ID NO:555) |
| H644673 | IRALMYIIQI | LIYLGRLNQA | LEYTKKALKL | NPDD | (SEQ ID NO:556) |
| OM70_NE1 | TQSYIKRASM | NLELGHPDKA | EEDFNKAIEQ | NAED | (SEQ ID NO:557) |
| D638755 | VTTSYNLARL | YEAMCEFHEA | EKLYKNILRE | HPNY | (SEQ ID NO:558) |
| CELF38B | AKIHYNLGKV | LGDNGLTKDA | EKNYWNAIKL | DPSY | (SEQ ID NO:559) |
| JT0603 | IPPYINRGNL | YSQQQDHHTA | IQDFTQAITY | DPNR | (SEQ ID NO:560) |
| YHBM_EC0 | AQLLYERGVL | YDSIGLRALA | RNDFSQALAI | RPDM | (SEQ ID NO:561) |
| OM70_NE2 | AAKLKELGNK | AYGSKDFNKA | IDLYSKAIIC | KPDP | (SEQ ID NO:562) |
| I495642 | SQALSKLGEL | YDSEGDKSQA | FQYYYESYRY | FPSN | (SEQ ID NO:563) |
| OM70_NE3 | PVYYSNRAAC | HNALAQWEQV | VADTTAALKL | DPHY | (SEQ ID NO:564) |
| PQ0180 | YRAYYNRGLA | YLDIAQPEQA | IADFQQALER | LPAT | (SEQ ID NO:565) |
| 2408032-184 | ARAFGRLGRA | KLSLGDAAAA | ADAYKKGLDF | DPNN | (SEQ ID NO:566) |
| HSU5897 | SATYSNRALC | YLVLKQYTEA | VKDCTEALKL | DGKN | (SEQ ID NO:567) |
| TAFKBP7 | ISIKLNNAAC | KLKLKDYKEA | EKICSKVLEL | ESTN | (SEQ ID NO:568) |
| YC37_CY0 | ILARINLARI | FELKNLKTEA | INMYQEVLIF | DPKN | (SEQ ID NO:569) |
| YC37_PO0 | IVALNNLAKI | YEDTKNILKA | EALYDKVLNI | AKSN | (SEQ ID NO:570) |
| D643710 | RDAWFNKALA | LRILGRYEEA | RECFFRGLAV | EKHL | (SEQ ID NO:571) |
| ATAC01 | SSVHASLGKI | YNQLKQYDKA | VLHFGIALDL | SPSP | (SEQ ID NO:572) |
| HSU2036 | TEALYNIGLT | YEKLNRLDEA | LDCFLKLHAI | LRNS | (SEQ ID NO:573) |
| CELK04G1 | AVAWSNLGCV | FNSQGEIWLA | IHHFEKAVTL | DPNF | (SEQ ID NO:574) |
| ACU8998 | HVLYSNRAAC | YMKLGRVPMA | VKDCDKAIEL | SPTF | (SEQ ID NO:575) |
| ATAC02 | TYAHTLCGHE | FAALEEFEDA | ERCYRKALGI | DTRH | (SEQ ID NO:576) |
| YHE3_PS | PAILDSMGWI | NYRQGKLADA | ERYLRQALQR | YPDH | (SEQ ID NO:577) |
| CELK04G2 | AVVHGNLACV | YYEQGLIDLA | IDTYKKAIDL | QPHF | (SEQ ID NO:578) |
| SC72_YE | PDVFVRKADC | LLKLRQWEEA | RATCERGLAL | APED | (SEQ ID NO:579) |
| CELK04G3 | AAAHSNLASI | LQQQGKLNDA | ILHYKEAIRI | APTF | (SEQ ID NO:580) |
| CELK04G4 | ADAHSNLASI | HKDAGNMAEA | IQSYSTALKL | KPDF | (SEQ ID NO:581) |
| CELK04G6 | IDAYINLAAA | LVSGGDLEQA | VTAYFNALQI | NPDL | (SEQ ID NO:582) |
| JC4775 | VNALKDRAEA | YLIEEMYDEA | IQDYETAQEH | NEND | (SEQ ID NO:583) |
| ATU62130 | AEACNNLGVL | YKDRDNLDKA | VECYQMALSI | KPNF | (SEQ ID NO:584) |
| ATU62131 | AEAFNNLGVL | YRDAGNITMA | IDAYEECLKI | DPDS | (SEQ ID NO:585) |
| ATU62132 | APAYYNLGVV | YSEMQYDNA | LSCYEKAALE | RPMY | (SEQ ID NO:586) |
| ATU62133 | VEAHIGKGIC | LQTQNKGNLA | FDCFSEAIRL | DPHN | (SEQ ID NO:587) |
| YCA1_PL | AQRLKELGNK | CFQEGKYEEA | VKYFSDAITN | DPLD | (SEQ ID NO:588) |
| ATU62134 | AQSLNNLGVV | YTVQGKMDAA | ASMIEKAILA | NPTY | (SEQ ID NO:589) |
| ATU62135 | ADAMYNLGVA | YGEMLKFDMA | IVFYELAFHF | NPHC | (SEQ ID NO:590) |
| RNU7655 | AEAYSNLGNV | YKERGQLQEA | IEHYRHALRL | KPDF | (SEQ ID NO:591) |
| ATU62136 | AIVLTDIGTS | LKLAGNTQEG | IQKYYEALKI | DPHY | (SEQ ID NO:592) |
| PS43_TO | TEAYLNLARG | HEKLCEFSEA | VAYCRTCLGA | EGGP | (SEQ ID NO:593) |
| D82942 | FNVRFRLGVA | LDNLGRFDEA | IDSFKIALAC | VPMK | (SEQ ID NO:594) |
| YPU2283 | SRGLASAARA | YRNEKRWDQA | LALWQSSLKK | DPTN | (SEQ ID NO:595) |
| CEUC55B6_3-59 | VAKHLELGSQ | FLARAQFADA | LTQYHAAIEL | DPKS | (SEQ ID NO:596) |
| S755780 | AFVYYRDGMS | AQADGEYAEA | LDNYEEALRL | EENP | (SEQ ID NO:597) |
| D86980 | FKALYRSGVA | FYHLGDYDKA | LYYLKEARTQ | QPTD | (SEQ ID NO:598) |
| D86981 | AKHYGNLGRL | YQSMRKFKEA | EEMHIKAIQI | KEQL | (SEQ ID NO:599) |
| H643320 | TSILRQKASI | LEILGKLDEA | LDCVNKILSI | KKDD | (SEQ ID NO:600) |
| S55383 | VKALYRRAQA | YTQLADLELA | EVDIKKALEI | DPEN | (SEQ ID NO:601) |
| YAD5_CL | GISYENLAWF | YYLTGKYDKA | IENFEKAISM | GSTN | (SEQ ID NO:602) |
| PPT1_YE | SIYFSNRAFA | HFKVDNFQSA | LNDCDEAIKL | DPKN | (SEQ ID NO:603) |
| CELC33H | AQRLKEQGNE | AFKKKYHKA | MTIYSKSLEH | WPDP | (SEQ ID NO:604) |
| CELC17G | AVLYFNRAAA | QKHLGNLRSA | IKDCSMGRKF | DPTH | (SEQ ID NO:605) |
| TPRD_HU0 | CLAYCGIGKV | YLKKNRFLEA | LNHFEKARTL | IYRL | (SEQ ID NO:606) |
| D64417 | ASLWYFKGKL | YEKQNKFEEA | LKYYNKAIQL | MPHH | (SEQ ID NO:607) |
| DMU18291 | VYSYTLLGHE | LVLTEEFDKA | MDYFRAAVVR | DPRH | (SEQ ID NO:608) |
| MXU7705 | FIAQGNLGWA | YYKKGEPDRA | VESIKAAVTT | NPNF | (SEQ ID NO:609) |
| RSMGPGN0 | GYAHLTIALA | HLGMSQFQQ | SFESAMNV | ANET | (SEQ ID NO:610) |

| | | | | |
|---|---|---|---|---|
| CEF52H3 | PSAYNNRAQA | YRLQNKPEKA | LDDLNEALSL | AGPK | (SEQ ID NO:611) |
| CYP4_BO | TKALYRRAQG | WQGLKEYDQA | LADLKKAQEI | APED | (SEQ ID NO:612) |
| IEFS_HU0 | AKAYARIGNS | YFKEEKYKDA | IHFYNKSLAE | HRTP | (SEQ ID NO:613) |
| S76202 | TSLQLLLGEI | YLSQNRPDQA | IAIYEAASKV | NGND | (SEQ ID NO:614) |
| IEFS_HU2 | IKGYTRKAAA | LEAMKDYTKA | MDVYQKALDL | DSSC | (SEQ ID NO:615) |
| F64399 | YKALFGLGKS | YYLMSDNKNS | IKYFEKVLEL | NPND | (SEQ ID NO:616) |
| IEFS_HU3 | MTYITNQAAV | YFEKGDYNKC | RELCEKAIEV | GREN | (SEQ ID NO:617) |
| SSN6_YE0 | AKALTSLAHL | YRSRDMFQRA | AELYERALLV | NPEL | (SEQ ID NO:618) |
| YHR7_YE0 | AVQLKNRGNH | FFTAKNFNEA | IKYYQYAIEL | DPNE | (SEQ ID NO:619) |
| IEFS_HU4 | GKGYSRKAAA | LEFLNRFEEA | KRTYEEGLKH | EANN | (SEQ ID NO:620) |
| SSN6_YE1 | SDVWATLGHC | YLMLDDLQRA | YNAYQQALYH | LSNP | (SEQ ID NO:621) |
| SSN6_YE2 | WDIWFQLGSV | LESMGEWQGA | KEAYEHVLAQ | NQHH | (SEQ ID NO:622) |
| SSN6_YE3 | PKLWHGIGIL | YDRYGSLDYA | EEAFAKVLEL | DPHF | (SEQ ID NO:623) |
| HEMY_EC | PLLWSTLGQS | LMKHGEWQEA | SLAFRAALKQ | RPDA | (SEQ ID NO:624) |
| SSN6_YE4 | ATTWYHLGRV | HMIRTDYTAA | YDAFQQAVNR | DSRN | (SEQ ID NO:625) |
| SSN6_YE5 | NEIYFRLGII | YKHQGKWSQA | LECFRYILPQ | PPAP | (SEQ ID NO:626) |
| RSMGPGN | FGALAGLGTM | LEQMDRPKPA | LEAYRAALAI | HPHL | (SEQ ID NO:627) |
| CYP7_YE | AKAYYRRGNS | YLKKKRLDEA | LQDYIFCKEK | NPDD | (SEQ ID NO:628) |
| S76685 | AIAFFNLAMI | YKAQGNLLEA | IKGYQEAITL | QPDY | (SEQ ID NO:629) |
| A55346 | AEELKTQAND | YFKAKDYENA | IKFYSKAIEL | NPSN | (SEQ ID NO:630) |
| CELC18H | FRALGCLITA | HSEMGKYEDM | LRFAVAQSEA | ARQM | (SEQ ID NO:631) |
| S761560 | VWAYINRGVA | YYDLGCHQKS | LDDYNQALVI | DSKC | (SEQ ID NO:632) |
| S761561 | VSSYILRAEI | HNLLGDFDAA | IEDCFTSLRL | NPMH | (SEQ ID NO:633) |
| NASP_HU | AETHYQLGLA | YGYNSQYDEA | VAQFSKSIEV | IENR | (SEQ ID NO:634) |
| S761562 | HEHLFKLGVE | QYILGNISDA | IDSFTKALEF | NDRF | (SEQ ID NO:635) |
| CELF10C0 | AALWVLIGHE | FMEMKNNAAA | CVSYRRAIEI | DPAD | (SEQ ID NO:636) |
| S761563 | DNTLYILGSS | FLSLEKYQSA | IDYLDQSLAL | NGNL | (SEQ ID NO:637) |
| C64478 | PIDWFNLAYA | LYHLEKYDSA | LEAINEALKI | SPSN | (SEQ ID NO:638) |
| CEF10B50 | VDAIASTALC | YAVLGNIDKA | TEFFNKALAI | DPFN | (SEQ ID NO:639) |
| ATAC98_24-445 | VDALYNLGGL | YMDLGRFQRA | SEMYTRVLTV | WPNH | (SEQ ID NO:640) |
| A565190 | ASTYSAIGYI | HSLMGNFENA | VDYFHTALGL | RRDD | (SEQ ID NO:641) |
| E644170 | VALWYFKXEL | YERLGKLDEA | LKCYEKVIEL | QPHY | (SEQ ID NO:642) |
| E644171 | PITWVFVGQL | YGMSGNCDEA | LKCYNKALGI | ENRF | (SEQ ID NO:643) |
| E644172 | IKALLSKARI | YERXGNIEAA | IEYYNKAVEN | IHKD | (SEQ ID NO:644) |
| CELF10C | HRGWYGLGQM | YDIMKMPAYA | LFYYQEAQKC | KPHD | (SEQ ID NO:645) |
| E644173 | YLALFLKGLA | LSAKGEIKEA | ITTFEELLSY | ESKN | (SEQ ID NO:646) |
| CYP4_BO0 | LSCVLNIGAC | KLKMSDWQGA | VDSCLEALEI | DPSN | (SEQ ID NO:647) |
| CYP4_BO1 | SEDLKNIGNT | FFKSQNWEMA | IKKYTKVLRY | VEGS | (SEQ ID NO:648) |
| MMU2783 | VNELKEKGNK | ALSAGNIDDA | LQCYSEAIKL | DPQN | (SEQ ID NO:649) |
| S752020 | FNELLRQGKA | YVDNGNFPQA | IAIYQQAAML | DGEN | (SEQ ID NO:650) |
| ENAC0 | LETMNNMALA | YEGLGKYKEA | EEIWAQLLEL | ANEC | (SEQ ID NO:651) |
| PFCYT12 | AEGLYFLGRA | YMAQDRSADA | AKVFERAVAL | AGRQ | (SEQ ID NO:652) |
| CC16_YE | SEIHCSLGYL | YLKTKKLQKA | IDHLHKSLYL | KPNN | (SEQ ID NO:653) |
| BSATPC1 | GSALYNIGNC | YDDKGELDQA | AEYFEKALPV | FEDY | (SEQ ID NO:654) |
| ECAE00 | ARGYAAVAVA | YRNLQQWQNS | LTLWQKALSL | EPQN | (SEQ ID NO:655) |
| ECAE01 | AGGYYGLARL | AARNGNFDAG | LDFCQQSLRA | CPTN | (SEQ ID NO:656) |
| ECAE02 | WFARHLLACF | YYNKRSYNKA | IAFWQRCVEM | SPEF | (SEQ ID NO:657) |
| YAD5_CL0 | NSVYRSLGIT | YAKIGDYKKS | EEYLKKALDA | EPEK | (SEQ ID NO:658) |
| PR06_YEAST-701 | HKFFLQLGQI | YHSMGNIEMS | RETYLSGTRL | VPNC | (SEQ ID NO:659) |
| YAD5_CL1 | INDVYSFALS | YHILGEPERA | LKYFLRAVEL | QPNV | (SEQ ID NO:660) |
| YPIA_BA | VNVHQRLAES | LSASGEFEDA | IPWYEKAVDE | NPDP | (SEQ ID NO:661) |
| NCF2_HU0 | SRICFNIGCM | YTILKNMTEA | EKAFTRSINR | DKHL | (SEQ ID NO:662) |
| TPU93844_2-211 | SVAYFYLGEI | FRLTKRFRKA | DIAYSTAVNF | EPSN | (SEQ ID NO:663) |
| SKI3_YE | VESWVGLGQA | YHACGRIEAS | IKVFDKAIQL | RPSH | (SEQ ID NO:664) |
| YHJL_EC | SEALGALGQA | YSQKGDRANA | VANLEKALAL | DPHS | (SEQ ID NO:665) |
| ECAE0 | ASLYYRALV | HFHNEKIEEA | RICIDKSLQL | EPRR | (SEQ ID NO:666) |
| C644780 | SRWWYVKGYI | YYKLGNYKDA | YESFMNALRV | NPKD | (SEQ ID NO:667) |
| OM70_YE | ALALKDKGNQ | FFRNKKYDDA | IKYYNWALEL | KEDP | (SEQ ID NO:668) |
| C644781 | SLYYAKKGDI | LYKLGDEEGA | IEAYNKAIKL | NSQN | (SEQ ID NO:669) |
| C644782 | YEDWVTEANY | YLDEGIYDKA | VECYLKALEK | KNTN | (SEQ ID NO:670) |
| C644783 | LNALFKAGKI | YLLFGDIDK | AFNEILQQ | NPSH | (SEQ ID NO:671) |

| | | | | | |
|---|---|---|---|---|---|
| A64512 | AIALSEIAKA | QYNIGMHDEA | LKNYDKAIFI | TEGV | (SEQ ID NO:672) |
| LMU7384 | AKGYVRRGAA | LHGMRRYDDA | IAAYEKGLKV | DPSN | (SEQ ID NO:673) |
| C644784 | ISTLKSLAIV | LEKSGKIDEA | ITTYTKILKI | VNSL | (SEQ ID NO:674) |
| PTSR_HU | PDVQCGLGVL | FNLSGEYDKA | VDCFTAALSV | RPND | (SEQ ID NO:675) |
| HSU4657 | AETFKEQGNA | YYAKKDYNEA | YNYYTKAIDM | CPKN | (SEQ ID NO:676) |
| CELK04G | ADAYSNMGNT | LKEMGDSSAA | IACYNRAIQI | NPAF | (SEQ ID NO:677) |
| YKD1_CA0 | PEMLNNVGAL | YMSMKQYEKA | EHHFKRAKER | LEEQ | (SEQ ID NO:678) |
| YKD1_CA1 | TLAHYGLGQM | YIHRNEIEEA | IKCFDTVHKR | LPNN | (SEQ ID NO:679) |
| S619910 | FRGYSRLGFA | KYAQGKPEEA | LEAYKKVLDI | EGDN | (SEQ ID NO:680) |
| S619911 | AEDLKMQGNK | AMANKDYELA | INKYTEAIKV | LPTN | (SEQ ID NO:681) |
| YKD1_CA2 | AEAFYQMGRC | RHAQGQFDGA | YKYYYQARQA | NNGE | (SEQ ID NO:682) |
| SR72_CA | AIIHGQMAYI | LQLQGRTEEA | LQLYNQIIKL | KPTD | (SEQ ID NO:683) |
| CELT09B | PKYYQNRAMC | YFQLNNLKMT | EEDCKRALEL | SPNE | (SEQ ID NO:684) |
| MXU77058_2-100 | PDANNAMGIL | LHLAFRRPDE | AVKHYTKALE | VRPD | (SEQ ID NO:685) |
| NRFG_EC | SEQWALLGEY | YLWQNDYSNS | LLAYRQALQL | RGEN | (SEQ ID NO:686) |
| NRFF_HA | AETWLQIGEA | YVQNNEFDSA | LVAYSNAEKL | SGSK | (SEQ ID NO:687) |
| CELT25F | ADVWYNIGQI | LVDIGDLVSA | ARSFRIALSH | DPDH | (SEQ ID NO:688) |
| S45064 | GQVSLSMGNA | FLGLSVFQKA | LESFEKALRY | AHNN | (SEQ ID NO:689) |
| S76315 | YLRYRALATT | YRDLEKYDLA | MANIDRALAI | TPDN | (SEQ ID NO:690) |
| CEAF16427_7-686 | VTVLQNIALA | EFHMQNYNRS | LLFYRKALHL | DPTH | (SEQ ID NO:691) |
| BIMA_EM0 | ANVHYLLGKL | YKMLRDKGNA | IKHFTTALNL | DPKA | (SEQ ID NO:692) |
| BIMA_EM1 | AAVLCLQGKL | WQAHKEHNKA | VECYAAALKL | NPFM | (SEQ ID NO:693) |
| S76156 | FNGFYNRGLA | YYKMGQIKKA | IKDFSDALIV | KPTF | (SEQ ID NO:694) |
| BIMA_EM2 | AVLICCIGLV | LEKMNNPKSA | LIQYNRACTL | APHS | (SEQ ID NO:695) |
| BIMA_EM3 | AYGFTLQGHE | YVANEEYDKA | LDAYRSGINA | DSRH | (SEQ ID NO:696) |
| NUC2_SC1 | SVLITCIGMI | YERCKDYKKA | LDFYDRACKL | DEKS | (SEQ ID NO:697) |
| JC4348 | GRVYNLLGNI | SFDQTNLKKA | LKYYQIAYQL | FDGN | (SEQ ID NO:698) |
| LBAPREL | AMTLNNMGEL | YHYKNEHDKS | KSYFLQSFQL | QQTV | (SEQ ID NO:699) |
| YO91_CA0 | LGTWFNAGYC | AWKLENFKES | TQCYHRCVSL | QPDH | (SEQ ID NO:700) |
| PTSR_YE | PEIQLCLGLL | FYTKDDFDKT | IDCFESALRV | NPND | (SEQ ID NO:701) |
| A60088 | ALCLLCFADI | HRHRSDIGKA | LPRYESSLNI | MTEI | (SEQ ID NO:702) |
| BSU55040 | VQACYDLAII | FFKQGRKEEA | LDYCVKGKSY | AEKY | (SEQ ID NO:703) |
| ATAC0 | PESWCAVGNC | YSLRKDHDTA | LKMFQRAIQL | NERF | (SEQ ID NO:704) |
| D64371 | AEYYYKKGVE | VGNKGDVEKA | LEYFNKAIEL | NPFY | (SEQ ID NO:705) |
| H64332 | AHAWYLKGRI | LKKIGNIKEA | LDALKMAINL | NENL | (SEQ ID NO:706) |
| S748060 | TSAWQNRGSA | LGVMGKLEEA | LANFDEALAQ | NPDD | (SEQ ID NO:707) |
| S748061 | AEDWLNIGIQ | QAQRGELETA | IASWGEAISL | NPQM | (SEQ ID NO:708) |
| YREC_SY0 | LNALLEQGNE | QLTNRNFAQA | VQHYRQALTL | EANN | (SEQ ID NO:709) |
| YREC_SY1 | LAYSLGLATV | QFRAGDYDQA | LVAYRKVLAK | DSNN | (SEQ ID NO:710) |
| YREC_SY2 | AEFFNALGFN | LAQSGDNRSA | INAYQRATQL | QPNN | (SEQ ID NO:711) |
| NPRA_BA | YYYYKFLGLL | YYCKEKYEDA | LEYYKKAEQR | FRSQ | (SEQ ID NO:712) |
| JC47750 | TAARIQRGHL | LLKQGKLDEA | EDDFKKVLKS | NPSE | (SEQ ID NO:713) |
| G020580 | AFAYTDLANM | YAEGGQYSNA | EDIFRKALRL | ENIT | (SEQ ID NO:714) |
| PPP5_RA | IKGYYRRAAS | NMALGKFRAA | LRDYETVVKV | KPND | (SEQ ID NO:715) |
| YQCH_BA | ATAFFNLGNC | YHKMDNLNKA | ARYIEQALVQ | YRKI | (SEQ ID NO:716) |
| CC27_HU2 | SVLLCHIGVV | QHALKKSEKA | LDTLNKAIVI | DPKN | (SEQ ID NO:717) |
| S61991 | AIYYANRAAA | HSSLKEYDQA | VKDAESAISI | DPSY | (SEQ ID NO:718) |
| YREC_SY | ARIHGALGYA | LSQLGNYSEA | VTAYRRATEL | EDDN | (SEQ ID NO:719) |
| CC27_HU3 | CFTLSLLGHV | YCKTDRLAKG | SECYQKSLSL | NPFL | (SEQ ID NO:720) |
| CC27_HU4 | SLVYFLIGKV | YKKLGQTHLA | LMNFSWAMDL | DPKG | (SEQ ID NO:721) |
| Consensus/60% | spsbhpbG.h | abpbscbppA | lphapcAlpl | sspp | |

Table 10  Alignment of Ankyrin Repeat Sequences

| ID | Sequence part 1 | Sequence part 2 | Sequence part 3 | SEQ ID |
|---|---|---|---|---|
| O04242/1-30 | NGHTAL*H*IAA | SK-----GD*E* | Q*C*V*KL*LLEHG A----DPNA | (SEQ ID NO:722) |
| O93130/1-30 | DGYTPL*HY*AI | KY-----NT*I* | R*I*A*KY*LLDNG A----D*M*TL | (SEQ ID NO:723) |
| VB18_VARV/1-32 | TGYTA*L*HCYL | YNN---YFTN | D*VL*K*VL*LNHG V----DVT*I* | (SEQ ID NO:724) |
| Q25328/1-30 | DKDTA*L*HLAV | YY-----KN*L* | Q*MIKLLI*KYG I----D*V*T*I* | (SEQ ID NO:725) |
| Q14349_1/1-30 | GGWTPI*I*W*AA* | EH-----KH*I* | EV*IRML*LTRG A----DVT*L* | (SEQ ID NO:726) |
| BCL3_HUMAN/1-30 | SGRSPL*I*H*AV* | EN-----NS*L* | S*MV*Q*LLL*QHG A----NV*N*A | (SEQ ID NO:727) |
| Q24241_4/1-31 | DGLTPL*H*C*AS* | RS-----GHV | EV*IKHLL*QQN AP---I*L*TK | (SEQ ID NO:728) |
| O43150/1-30 | KGSTA*L*HYCC | LT-----DNA | E*CLKLL*RGK A----S*IEI* | (SEQ ID NO:729) |
| G3790744/1-30 | NKQTS*L*H*Y*AC | SK-----NHV | E*IV*K*LLI*EAD P----N*II*N | (SEQ ID NO:730) |
| Q25328_3/1-30 | EKYTPL*H*L*AA* | MS-----KYP | E*L*IQ*ILL*DQG S----N*F*EA | (SEQ ID NO:731) |
| GLP1_CAEEL/1-30 | KGRTA*L*HY*AA* | MH-----DN*E* | E*MVIML*VRRS S----NKDK | (SEQ ID NO:732) |
| YA2A_SCHPO/1-31 | DKMTPL*HW*SI | VG-----GN*L* | K*C*M*KLI*LKEG G*I*---P*C*TA | (SEQ ID NO:733) |
| VB04_VACCC/1-30 | NRYTPL*HY*VS | CR-----NK*Y* | D*FV*K*LLI*SKG A----NV*N*A | (SEQ ID NO:734) |
| HT16_HYDAT/1-33 | GLDTR*L*HL*AC* | EE-----KNP | N*T*V*KELL*QDS V*I*K-ENV*N*A | (SEQ ID NO:735) |
| O04703_1/1-30 | HRSTA*I*HV*AI* | EE-----NH*L* | E*MV*K*LLL*LNG D----E*I*DD | (SEQ ID NO:736) |
| G3790744_1/1-30 | EGNTA*L*HL*AC* | DE-----NRG | D*V*A*ILL*VNRG A----D*M*KM | (SEQ ID NO:737) |
| Q25338_1/1-30 | GNLTV*L*HL*AV* | ST-----GQ*I* | N*II*K*EL*LKRG S----N*I*EE | (SEQ ID NO:738) |
| Q21920/1-30 | TLETPL*T*I*AC* | AN-----GHK | D*IVELL*LKEG A----N*I*E*H* | (SEQ ID NO:739) |
| O16568/1-30 | DGKTC*L*HV*AI* | EN-----LHK | E*T*I*ELM*IQSG A----DK*Y*A | (SEQ ID NO:740) |
| Q21920_1/1-30 | TGDTPL*S*L*AA* | RN-----GY*I* | A*IMKML*IEKG G----D*L*TA | (SEQ ID NO:741) |
| O82630/1-30 | DGRSPL*H*L*AA* | SR-----GY*E* | D*I*T*LYL*IQES V----DV*N*I | (SEQ ID NO:742) |
| O00542/1-31 | QSRTL*L*H*H*AV | ST-----GSK | D*VVRYLL*DHA PP---E*I*LD | (SEQ ID NO:743) |
| Q25338_2/1-30 | DGSTA*L*HL*AV* | SG-----RKM | K*TV*ET*LL*NKG A----N*L*KE | (SEQ ID NO:744) |
| Q86916/1-32 | NGKNL*L*H*M*YM | CNF---NVR*I* | N*V*I*KLL*IDSG V----N*F*LQ | (SEQ ID NO:745) |
| Q23595/1-30 | IGQNA*L*H*M*AA | RV-----GN*L* | N*ILKYL*LDRL P----E*L*RD | (SEQ ID NO:746) |
| Q21587/1-30 | IGCSA*L*H*L*CA | EH-----GHY | R*MIKLLI*QYM K----VV*E*Q | (SEQ ID NO:747) |
| P87621/1-34 | DGNTPL*H*I*V*C | SKT---VKNV | D*II*D*LL*LPST DV--NKQNK | (SEQ ID NO:748) |
| YD57_SCHPO/1-33 | AGWTPL*M*I*S*I | NNR---SVPD | N*V*I*EEL*INRS DV---D*P*T*I* | (SEQ ID NO:749) |
| O04097_1/1-30 | HGRTPL*H*H*CI* | SS-----GNH | K*F*A*KIL*LRRG A----R*P*S*I* | (SEQ ID NO:750) |
| P87621_2/1-30 | YDSTDF*KM*AV | EV-----GS*I* | R*CV*K*YL*LDND I----I*C*ED | (SEQ ID NO:751) |
| Q84644_1/1-30 | YGNTPL*A*I*AI* | ST-----GQC | D*MV*K*LL*MNYV T----N*I*FD | (SEQ ID NO:752) |
| O17055_1/1-31 | YGDTA*L*HL*SC* | YS-----GR*L* | D*IV*KS*IL*DSS PT---N*I*V*N* | (SEQ ID NO:753) |
| VB18_VARV_1/1-3 | CGNTPF*HL*YL | SIE--MCNN*I* | H*MT*KM*LL*TFN P----N*F*E*I* | (SEQ ID NO:754) |
| HRG_COWPX/1-32 | NYCTA*L*QY*YI* | KSS---H*I*D*I* | D*I*V*KLL*MKGI D----N*T*AY | (SEQ ID NO:755) |
| O55222_1/1-30 | HGFSPL*HW*AC | RE-----GRS | A*VV*E*ML*IMRG A----R*I*NV | (SEQ ID NO:756) |
| Q28282/1-30 | EGRSAF*H*V*V*A | SK-----GN*L* | E*CL*NA*IL*IHG V----D*I*TT | (SEQ ID NO:757) |
| G3929219_3/1-30 | DFMTPL*H*V*AA* | ER-----AHN | D*V*M*EVL*HKHG A----K*M*NA | (SEQ ID NO:758) |
| BCL3_HUMAN_1/1- | DGDTPL*HI*AV | VQGN-LPAV*H* | R*LV*N*LF*QQGG R----E*L*D*I* | (SEQ ID NO:759) |
| BCL3_HUMAN_2/1- | HGQTAA*H*L*AC* | EH-----RSP | T*CLRALL*DSA AP--GT*L*DL | (SEQ ID NO:760) |
| O73630/1-30 | HGLSPV*HW*SV | KM-----KN*E* | K*CLV*L*L*VKAG A----NV*N*S | (SEQ ID NO:761) |
| Q18297_2/1-30 | DQNTPM*HI*VA | SN-----GY*L* | E*MM*Q*LL*QKHG A----S*I*TQ | (SEQ ID NO:762) |
| Q94527/1-31 | DGLTPL*HM*AI | RQ-----NKY | D*V*A*KKL*ISYD RT---S*I*SV | (SEQ ID NO:763) |
| O90757/1-30 | KGYTA*L*YY*TI* | CN-----NN*Y* | D*MV*C*FLL*EKN A----D*I*S*I* | (SEQ ID NO:764) |
| HT16_HYDAT_2/1- | NGRTPVQV*V*C | FY-----NHA | S*TL*H*LL*ISKG SA---D*F*LK | (SEQ ID NO:765) |
| P87609_1/1-31 | NGYTC*I*A*IAI* | NE----SRN*I* | E*LLKML*LCHK P----T*L*DC | (SEQ ID NO:766) |
| O90757_1/1-30 | GGRTS*L*H*L*AI | KE-----RN*Y* | E*A*A*FVL*INNG A----NV*D*S | (SEQ ID NO:767) |
| Q20109_1/1-31 | MGWSPL*MW*AV | YK-----NH*L* | D*VV*D*LL*VNAK VN---A*C*DK | (SEQ ID NO:768) |
| SWI6_YEAST_1/1- | HGNTPL*HW*LT | SI-----AN*L* | E*LV*K*HL*VKHG S----NR*L*Y | (SEQ ID NO:769) |
| P93755/1-31 | DYRTPL*M*V*AA* | TY-----GS*I* | D*VIKLI*VSLT DA---DV*N*R | (SEQ ID NO:770) |
| Q19995/1-31 | AGRTPL*HY*AA | AD----PNG*E* | H*M*I*KV*LQKSG G----DA*F*I | (SEQ ID NO:771) |
| O48738/1-30 | DGFTP*I*H*M*AA | KE-----GHV | R*IIKEF*LKHC P----DSRE | (SEQ ID NO:772) |
| Q89202/1-30 | ILLSC*I*H*I*T*I* | KN-----GHV | D*MM*I*LL*LDYM T----S*T*NT | (SEQ ID NO:773) |
| G3927831_1/1-30 | HKQTPL*ML*AA | MY-----GR*I* | S*CVKKL*AEVG A----N*I*LM | (SEQ ID NO:774) |
| FEM1_CAEEL_3/1- | HGHTC*L*M*I*AS | YR-----NKV | G*IV*E*EL*LKTG I----D*V*NK | (SEQ ID NO:775) |
| Q18297_3/1-30 | EGKTAFD*I*AC | EN-----DHK | D*V*ARA*F*LETD Q----W*K*N*L* | (SEQ ID NO:776) |
| Q38898_1/1-30 | HGVTA*L*QV*AM* | AE-----DQM | D*MVNLL*ATNG A----D*VV*C | (SEQ ID NO:777) |
| HRG_COWPX_2/1-3 | N*D*FN*I*FT*YM*K | SK----NVD | *I*K*VL*VEHG F----D*F*SV | (SEQ ID NO:778) |

```
O43988/1-30        EGYTPIHYAV  RE-----SRI   ETVKFLIKFN  S----KLNI   (SEQ ID NO:779)
O43988_1/1-30      QGYTPLYLAA  KA-----GKT   NFVKYLLSKG  R----SKKI   (SEQ ID NO:780)
AKR1_YEAST/1-30    EGFTPLHWGT  VK-----GQP   HVLKYLIQDG  A----DFFQ   (SEQ ID NO:781)
Q21920_5/1-30      TKDTALTISA  EK-----GHE   KFVRMLLNGD  A----AVDV   (SEQ ID NO:782)
P87621_3/1-32      QHKTPLYYLS  GTD---DEVI   ERINLLVRYG  A----KINN   (SEQ ID NO:783)
O18270_1/1-30      EGRSCLMWAV  CA-----GNI   EVINYLIQRE  D----APKR   (SEQ ID NO:784)
VC17_VACCC/1-33    RGNNALHCYV  SNK--CDTDI   KIVRLLLSRG  V----ERLC   (SEQ ID NO:785)
VC09_VACCC/1-30    HGCSILYHCI  KS-----HSV   SLVEWLIDNG  A----DINI   (SEQ ID NO:786)
YIA1_YEAST/1-30    FDNSPLFLAS  LC-----GHE   AVVKLLLQRG  A----VCDR   (SEQ ID NO:787)
Q89540_1/1-32      CGRTPLHAYV  QYD---GVRP   EVVALMLEAG  A----DVVC   (SEQ ID NO:788)
Q25338_5/1-31      NNWTPLHFAI  YF-----KKE   DAAKELLKQD  DI---NLTI   (SEQ ID NO:789)
O17055_3/1-30      HLLPALHLAA  MI-----GDS   EMLTILLNSG  A----NIHV   (SEQ ID NO:790)
O44872/1-30        LGRNALLIAI  EN-----ENI   EMIELLLDHN  I----ETGD   (SEQ ID NO:791)
1790447/1-30       ARDTGLFMAM  QR-----GHM   NVINTIFNAL  P----TLFN   (SEQ ID NO:792)
HRG_COWPX_3/1-3    YIISHLYSES  DSR--SCVNP   EVVKCLINHG  I----NPSS   (SEQ ID NO:793)
Q21587_2/1-30      EKPSPIDIAV  LK-----DDP   HLLKIVLDAG  A----NPNA   (SEQ ID NO:794)
VB18_VARV_2/1-3    EGKTLLHIAC  EY-----NNT   HVIDYLIRIN  G----DINA   (SEQ ID NO:795)
VB04_VACCC_1/1-    YGCTLLHRCI  YH(5)SESYN   ELIKILLNNG  S----DVDK   (SEQ ID NO:796)
O75407/1-30        LNSTPLHWAT  RQ-----GHL   SMVVQLMKYG  A----DPSL   (SEQ ID NO:797)
P87621_4/1-31      FGDSPLTLLI  KT----LSPA   HLINKLLSTS  N----VITD   (SEQ ID NO:798)
O54807_1/1-31      EGRTPVHVAI  SN-----QHS   VIIQLLISHP  NI---ELSV   (SEQ ID NO:799)
FEM1_CAEEL_4/1-    QGVDPLMGAA  LS-----GFL   DVLNVLADQM  PS---GIHK   (SEQ ID NO:800)
Q84566/1-33        GYRSLLQYAL  SWG--RHGNS   KVIELLLKHG  A----NVDY   (SEQ ID NO:801)
Q27105_1/1-28      HGRTSLYWAV  YY-----KNK   EIVELLQSHG  A----TI--   (SEQ ID NO:802)
O13075/1-30        NGDNVLHLSI  IH-----LHR   ELVKNLLEVM  P----DMNY   (SEQ ID NO:803)
G3930527_4/1-30    QRSTPLIIAA  RN-----GHA   KVVRLLLEHY  R----VQTQ   (SEQ ID NO:804)
G3925387_5/1-30    DGHSLLHWAA  LG-----GNA   DVCQILIENK  I----NPNV   (SEQ ID NO:805)
O88849_6/1-30      EGRTSFMWAA  GK-----GND   DVLRTMLSLK  S----DIDI   (SEQ ID NO:806)
O88849_7/1-30      QGATPLHYAA  QS-----NFA   ETVKVFLQHP  S----VKDD   (SEQ ID NO:807)
O17055_4/1-30      EGNQALHYAA  KS-----GSL   VILNMLIKQV  R----GTND   (SEQ ID NO:808)
Q18297_5/1-30      NKMTPLLLAC  VH-----GSQ   EIIQELIKAN  S----NVTK   (SEQ ID NO:809)
FEM1_CAEEL_5/1-    NNDTPMHILL  RAR---EFRK   SLVRALLVRG  T----WLFA   (SEQ ID NO:810)
O75762_4/1-30      DGCTPLHYAC  RQ-----GGP   GSVNNLLGFN  V----SIHS   (SEQ ID NO:811)
O14586_1/1-30      SWATGLHLSV  LF-----GHV   ECLLVLLDHN  A----TINC   (SEQ ID NO:812)
P90784/1-30        NGNTALHLCV  IH-----DKM   DMLDAVLEAG  G----NIRL   (SEQ ID NO:813)
Q94527_1/1-30      DGDSALHVAC  QQ-----DRA   HYIRPLLGMG  C----NPNL   (SEQ ID NO:814)
O54807_2/1-31      YLQTPLHMAI  AY-----NHP   DVVSVILEQK  AN---ALHA   (SEQ ID NO:815)
O75762_5/1-30      NGWTALHHAS  MG-----GYT   QTMKVILDTN  L----KCTD   (SEQ ID NO:816)
157038_1/1-31      DGDTPLHLAC  IS-----GSV   DVVAALIRMA  PH---PCLL   (SEQ ID NO:817)
Q02989_4/1-30      NGNTLLHLFS  ST-----GEL   EVVQFLMQNG  A----NFRL   (SEQ ID NO:818)
O60736_1/1-32      QGWTVLHEAV  ST-----GDP   EMVYTVLQHR  DY-HNTSM    (SEQ ID NO:819)
ANK1_MOUSE_18/1    DGFTPLAVAL  QQ-----GHE   NVVAHLINYG  -----TKGK   (SEQ ID NO:820)
O61222_1/1-33      YGRTPLMYAI  MT-----NNR   SVVDAIVGDG  KLA-VVLHK   (SEQ ID NO:821)
Q62422/1-31        AGSTALYWAC  HG-----GHK   DIVEVLFTQP  NV---ELNQ   (SEQ ID NO:822)
Q24241_15/1-30     NGLSALHMAA  QG-----EHD   EAAHLLLDNK  A----PVDE   (SEQ ID NO:823)
YD57_SCHPO_2/1-    DKRTPLHWAC  SV-----GKV   NTIYFLLKQP  NI---KPDE   (SEQ ID NO:824)
G3927831_2/1-32    NRRTCLHYAA  YY-----GHA   NCVQAILSAA  QS--SPVAV   (SEQ ID NO:825)
P70770_1/1-30      DNNNALWFAC  FG-----NHY   DLIHLLLAAK  I----NIDN   (SEQ ID NO:826)
Q94527_2/1-30      AGNTPLHVAV  KE-----EHL   SCVESFINGV  P----TVQL   (SEQ ID NO:827)
P72763_4/1-30      QGTTALEWAI  KQ-----QNL   SMVRKLIEHH  A----PLDL   (SEQ ID NO:828)
O60733_2/1-30      EGCTPLHLAC  RK-----GDG   EILVELVQYC  H----TQMD   (SEQ ID NO:829)
KBF1_MOUSE/1-30    KSYPQVKICN  YV-----GPA   KVIVQLVTNG  K----NIHL   (SEQ ID NO:830)
O88849_9/1-31      ERYTPLDYAL  LG-----ERH   EVIQFMLEHG  AL---SIAA   (SEQ ID NO:831)
O82630_1/1-30      LGSTPLLEAI  KN-----GND   RVAALLVKEG  A----TLNI   (SEQ ID NO:832)
YAHD_ECOLI/1-30    QGKTAITLAS  LY-----QQY   ACVQALIDAG  A----DINK   (SEQ ID NO:833)
Q84644_3/1-30      REEPILHVIT  SI-----GNV   NMMKTMLDEG  A----DINV   (SEQ ID NO:834)
157038_2/1-30      SGRTPLHIAI  EG-----CNE   DLANFLLDEC  E----KLNL   (SEQ ID NO:835)
1790447_1/1-34     YGCPGLYLAM  QN-----GHS   DIVKVILEAL  PSLAQEINI   (SEQ ID NO:836)
O75762_6/1-31      NMMAPLHIAV  QG-----MNN   EVMKVLLEHR  TI---DVNL   (SEQ ID NO:837)
LI12_CAEEL_2/1-    DENTPLMLAV  LA-----RRR   RLVAYLMKAG  A----DPTI   (SEQ ID NO:838)
G3970962_1/1-30    HGYTALMFAA  LS-----GN    TWVMLEAG    A----ETDV   (SEQ ID NO:839)
```

```
VC09_VACCC_2/1-    QDLLLEYVSY  HT-----VYI  NVIKCMIDEG  A----TLYR  (SEQ ID NO:840)
O83807_2/1-31      SGKTPWHWAV  RA-----LDR  DLIKHLVTLG  PP---TQER  (SEQ ID NO:841)
O23296/1-30        DGNTALYYAI  EG-----RYL  EMATCLVNAD  K----DAPF  (SEQ ID NO:842)
G3927831_3/1-30    DRHSVLHVAA  AN-----GQI  EILSLLLERF  T----NPDL  (SEQ ID NO:843)
YB07_FOWPM_3/1-    NGYSPIKMAV  RL-----RDV  EMIKLLMSYN  TY---PDYNY (SEQ ID NO:844)
RN5A_MOUSE_2/1-    NGFTAFMEAA  ER-----GNA  EALRFLFAKG  A----NVNL  (SEQ ID NO:845)
O54910_1/1-30      HGDTALHVAC  RR-----QNL  ACACCLLEEQ  P----EPGR  (SEQ ID NO:846)
O44997_4/1-32      GGYEPMHTCY  DHF---VGNA  DCIHLILYRT  S----DPTE  (SEQ ID NO:847)
O00306/1-30        REQTPLFLAA  RE-----GAV  EVAQLLLGLG  A----AREL  (SEQ ID NO:848)
O61222_2/1-30      SGNTAAHYAA  AY-----GFL  DCLKLLASID  D----NILS  (SEQ ID NO:849)
O74205/1-30        DQFSPLMTAI  SL-----GRL  DIARILLQSG  A----PLDI  (SEQ ID NO:850)
VB18_VARV_3/1-3    EYIKSRYMLL  KEE---DIDE  NIVSTLLDKG  I----DPNF  (SEQ ID NO:851)
P87603_1/1-33      HLITPLHSYL  RRD--ESISA  SVLKKVIELG  A----DRNL  (SEQ ID NO:852)
O82630_2/1-30      DHRTPLHVAA  SE-----GFY  VLAIQLVEAS  A----NVLA  (SEQ ID NO:853)
Q25328_4/1-30      KTDTPLCYAS  EN-----GHF  TVVQYLVSNG  A----KVNH  (SEQ ID NO:854)
JC4356/1-30        AGQTAAMYAA  LF-----KRT  EVLKELTDKG  A----DLSI  (SEQ ID NO:855)
O50999/1-30        NGNPIFTYAI  NV-----KAK  SIINYLITKE  F----NINL  (SEQ ID NO:856)
Q20109_3/1-30      YSSTALMIAT  RG-----NFI  QVVELLLTRE  P----NVNV  (SEQ ID NO:857)
GLP1_CAEEL_2/1-    SERSALHEAV  VN-----KDL  RILRHLLTDK  RLL-KEIDE  (SEQ ID NO:858)
Q86916_1/1-33      NNLSALAHYL  SFN--KNVEP  EIVKILIDSG  S----SITE  (SEQ ID NO:859)
Q92527_1/1-30      RYNTVLHYAV  CG-----QSL  SLVEKLLEYE  A----DLEA  (SEQ ID NO:860)
O90757_4/1-30      NDYRLLHSAI  TH-----ENK  KMIELLCLHG  I----NINV  (SEQ ID NO:861)
I50404_2/1-32      YGNSLLHLAL  QA-----ADE  EMLRMLLAHL  GS--ATPYL  (SEQ ID NO:862)
Q94400_1/1-31      GGATALQYAV  IN-----GNE  YLVEILTSHA  SI---DVNI  (SEQ ID NO:863)
Q83730/1-32        DGYGPVQTYI  HSK---NVVL  DTLRELVRAG  A----TVHD  (SEQ ID NO:864)
O44997_5/1-30      NGDTPLHVAC  RF-----AQH  TVAGYVANEK  I----DVDS  (SEQ ID NO:865)
Q25338_6/1-30      NKYLPIHKAI  IN-----DDL  DMVRLFLEKD  P----SLKD  (SEQ ID NO:866)
O90760_3/1-30      TGLTPLDIAM  SC-----NNY  EIISLLVSHV  I----RLDY  (SEQ ID NO:867)
391941_1/1-30      NGHSPLFYAL  WE-----SHV  DVLNALLQRP  L----NLPS  (SEQ ID NO:868)
1790447_2/1-34     TSSHVLYHVM  AN-----GDA  DMLKIVLNAL  PLLIRTCHL  (SEQ ID NO:869)
Q02979_2/1-30      YKRTPLHYSC  QY-----GLS  EVTKLIIKLM  K----EWNI  (SEQ ID NO:870)
O74205_1/1-30      EGNSLLHIAV  KT-----NSL  SITRLLLERY  K----SCRE  (SEQ ID NO:871)
Q86916_2/1-32      LYETPLFSCV  EKD---KVNV  EILNFLIENG  S----DINF  (SEQ ID NO:872)
Q94527_3/1-31      DGNNALHMAV  LE-----QSV  ELLVLILDAQ  NE---NLTD  (SEQ ID NO:873)
O15084_16/1-30     NWQTPLHIAA  AN-----KAV  KCAEALVPLL  S----NVNV  (SEQ ID NO:874)
YG4X_YEAST_1/1-    DGRIPLHWSV  SF-----QAH  EITSFLLSKM  E----NVNL  (SEQ ID NO:875)
O18270_5/1-30      NGYTALHLAA  MV-----GHE  KVCKILTNQP  T----SIFP  (SEQ ID NO:876)
Q14349_4/1-30      QQRTPLMEAV  VN-----NHL  EVARYMVQRG  G----CVYS  (SEQ ID NO:877)
JQ1744_2/1-34      KFHTPLHTYV  DKNS-KGVAP  SIIQYMIDRG  V----STAR  (SEQ ID NO:878)
PLU_DROME/1-32     FGQNALTLAT  YA-----GHL  TLVKELLRRR  SY-KDFNL   (SEQ ID NO:879)
O54807_4/1-31      NGNNALHLAV  MH-----GRL  NNIRALLTEC  TV---DAEA  (SEQ ID NO:880)
O15084_17/1-30     ATISPLHLAA  YH-----GHH  QALEVLVQSL  L----DLDV  (SEQ ID NO:881)
Q93203_1/1-30      PAIYPFHLAA  KY-----NHV  ECMQALREHG  F----SINY  (SEQ ID NO:882)
O88849_11/1-31     EGRTPLHFAV  AD-----GNL  TVVDVLTSYE  SC---NITS  (SEQ ID NO:883)
Q17643/1-30        AMMNTLHMAV  AH-----KQR  DIVELLLKNG  Y----DPNT  (SEQ ID NO:884)
O48738_2/1-30      DEASPLYMAV  EA-----GYH  ELVLKMLESS  S----SPSI  (SEQ ID NO:885)
1790447_3/1-30     QKYSAFELAF  EF-----GHR  VIAELILNTL  N----KMAE  (SEQ ID NO:886)
Q02989_9/1-31      SECNPLHEAA  AY-----AHL  DLVKYFVQER  GI---NPAE  (SEQ ID NO:887)
Q19995_1/1-31      FGCTPLHSAV  VH-----EHT  EIVRYIAGHY  NS---VLNA  (SEQ ID NO:888)
O90760_4/1-30      DRNSLLLVAT  KR-----NYI  DVVRYLVKKG  V----DINF  (SEQ ID NO:889)
Q89340_5/1-31      SGCTPLHRAV  FN-----GHD  ACASMLVNKI  VS---ERPL  (SEQ ID NO:890)
O90757_5/1-31      NKYSMLHFLS  TS----NKYH  NVMAVLLDKG  I----DVNI  (SEQ ID NO:891)
Q20313_1/1-30      QDSDIFLSAC  MS-----GDE  EEVEELLNKG  A----NINT  (SEQ ID NO:892)
Q89202_2/1-29      KGNTALYYAV  DS-----GNM  QTVKLFVKKN  -----WRLM  (SEQ ID NO:893)
YMV8_YEAST_2/1-    KGNTCVHLAL  MK-----GHE  QTLHLLLQQF  P----RFIN  (SEQ ID NO:894)
157038_3/1-30      VAQTPLHLAA  LT-----AQP  NIMRILLLAG  A----EPTV  (SEQ ID NO:895)
AKR1_YEAST_2/1-    QGFNLLHLSV  NSSN-IMLVL  YVLFNVVSKG  LL---DIDC  (SEQ ID NO:896)
Q18297_6/1-30      REKELIHFAA  EK-----GFL  EVLKALVEAG  G----NKNE  (SEQ ID NO:897)
O68219/1-30        DGRTIIHYAA  KD-----GNL  EILQQALGRK  S----SYSK  (SEQ ID NO:898)
Q20109_5/1-30      FGNWILTSAV  RS-----GNA  AIVRMILDKF  A----DINC  (SEQ ID NO:899)
Q25328_7/1-30      DGMNFFYYAV  QN-----GH   VKYAMSEK   D----KFEW  (SEQ ID NO:900)
```

```
O61222_4/1-30    EDNTPLHYAL  TN-----GNL  MLFNLMLDKV  A----NKRN  (SEQ ID NO:901)
Q21587_5/1-30    LLKSALHFAL  LS-----GNH  DLVKFMIANG  S----NVNM  (SEQ ID NO:902)
O61222_5/1-30    KKRTPLIHAM  LN-----GQI  HTAAFLLAKG  A----SLTL  (SEQ ID NO:903)
Q21920_13/1-30   RKISPMMAAF  RK-----GHV  EIVKYMVNSA  K----QFPN  (SEQ ID NO:904)
Q83730_1/1-30    LGNSCLDLAV  LN-----GNK  YMVHRLLRKT  I----TPDA  (SEQ ID NO:905)
Q18297_7/1-30    DTKTVLHTAA  FY-----GNE  SIVRYFIAEG  V----TIDR  (SEQ ID NO:906)
Q18663_1/1-31    EEFTPLHNAV  KM-----GNT  VMAKNFIDSK  SV---WIDE  (SEQ ID NO:907)
Q25328_8/1-31    GLLSALHYAI  LY-----KHD  DVASFLMRSS  NV---NVNL  (SEQ ID NO:908)
O18152_4/1-30    YGQHPMMIAA  AN-----GNL  KVLEYLMGIS  D----IINQ  (SEQ ID NO:909)
O54807_6/1-30    HRQTALHLAA  QQ-----DLP  TICSVLLENG  V----DFAA  (SEQ ID NO:910)
O73630_3/1-30    NGDTPLHLAV  IH-----GQS  SVIEQLVQII  L----SIPN  (SEQ ID NO:911)
35040_3/1-30     RGHTPLDLTC  ST-----LVK  TLLLNAAQNT  M----EPPL  (SEQ ID NO:912)
Q19995_2/1-33    DGRTPLHHAY  MK-----RRN  ELIEYLLYIC  PDSA-NIKD  (SEQ ID NO:913)
DAPK_HUMAN_3/1-  DADIRLWVNG  CKL--ANRGA  ELLVLLVNHG  Q----GIEV  (SEQ ID NO:914)
Q25328_9/1-30    KGLAPLLAFS  KK-----GNL  DMVKYLFDKN  A----NVYI  (SEQ ID NO:915)
O43150_1/1-33    PDETALHLAV  RSV--DRTSL  HIVDFLVQNS  G----NLDK  (SEQ ID NO:916)
YAR1_YEAST_1/1-  SDSTALHMAA  AN-----GHI  ETVRYILETV  S----RANS  (SEQ ID NO:917)
Q84566_2/1-31    NGHTLLLWSA  EK----SKNM  ELVKYLIHAG  V----EISQ  (SEQ ID NO:918)
S57237/1-30      YGKSPINDAA  EN-----QQV  ECLNVLVQHG  T----SVDY  (SEQ ID NO:919)
35040_4/1-33     NGDTPLHLAI  IHG--QTSVI  EQIVYIHHA   Q----DLGV  (SEQ ID NO:920)
Q18587_1/1-30    NGRTAIQIAA  DY-----GQT  SIIAYLISIG  A----NIQD  (SEQ ID NO:921)
Q02989_10/1-30   QENTPITVAI  FA-----NKV  SILNYLVGIG  A----DPNQ  (SEQ ID NO:922)
Q09493_1/1-32    IGLTPLYYNM  LTA---DSND  QVAEILLREA  A----DIGV  (SEQ ID NO:923)
O15084_18/1-30   RGRTPIHLSA  AC-----GHI  GVLGALLQSA  A----SMDA  (SEQ ID NO:924)
Q21920_15/1-33   KKNTPLMEAC  AGD--QGDQA  GVVKLLLSKH  A----EVDV  (SEQ ID NO:925)
O83807_6/1-30    DGSTPLHVMA  KR-----GYT  GFVQFLVDRK  V----NLNA  (SEQ ID NO:926)
D1037943_4/1-30  YDATAMHRAA  AK-----GNL  KMVHILLFYK  A----STNI  (SEQ ID NO:927)
YB07_FOWPM_4/1-  DIESELHEAV  EE-----GDV  VKVEELLDSG  K----FIND  (SEQ ID NO:928)
O45398_1/1-30    DDRTALDIAV  EK-----RDL  KSARICIKGG  A----DVNA  (SEQ ID NO:929)
O49409_1/1-30    DGGVRLMYLA  NE-----GDI  EGIKELIDSG  I----DANY  (SEQ ID NO:930)
O83807_8/1-30    KGETPLVLTI  DR-----DHR  DLTAYFVSLG  A----DIHA  (SEQ ID NO:931)
S57237_1/1-31    NDVTPVYLAA  QE-----GHL  EVLKFLVLEA  GG---SLYV  (SEQ ID NO:932)
JQ1744_3/1-30    YGFTPLLSAV  YA-----VNL  NFFNHFVKLG  A----DINV  (SEQ ID NO:933)
E1350345_1/1-30  NGRSCLFYAR  SN-----GFR  EVFDMLVTAG  L----SPDY  (SEQ ID NO:934)
P87611_1/1-35    IGKTALYYYI  ITRSRDKLSL  DVINCLISYE  K----EILY  (SEQ ID NO:935)
Q23595_2/1-30    RGQSLLHIAC  LC-----GHE  HIVRWILNRS  G----SDAI  (SEQ ID NO:936)
P90902_2/1-30    DFWQPVHAAA  CW-----AQP  DLIELLCQYG  G----DIHA  (SEQ ID NO:937)
VC17_VACCC_1/1-  MCKNSLHYYI  SS(4)QSLSK  DVIKCLINNN  V----SIHG  (SEQ ID NO:938)
JQ1744_4/1-32    HGNSSLHYYM  RRY---MLCK  SVLDILLSTG  V----DING  (SEQ ID NO:939)
Q93203_2/1-30    KNILPIHLAA  WN-----GNL  EIVKMLLQT   M----EKPA  (SEQ ID NO:940)
O45398_2/1-30    EERTPLICAV  MA-----NNH  IMCETLIRSG  V----NCDV  (SEQ ID NO:941)
O00522_1/1-31    DHWAPIHYAC  WY-----GKV  EATRILLEKG  KC---NPNL  (SEQ ID NO:942)
Q02989_11/1-30   SGFTPLHLSI  SS-----TSE  TAAILIRNTN  A----VINI  (SEQ ID NO:943)
YMV8_YEAST_3/1-  NGWSSLHYAS  YH-----GRY  LICVYLIQLG  H----DKHE  (SEQ ID NO:944)
Q07045_4/1-35    NSNILQHILI  EYMTFDDIDI  HLVECMLAYG  A----VVNK  (SEQ ID NO:945)
O15084_20/1-30   DGKTPLHMTA  LH-----GRF  SRSQTIIQSG  A----VIDC  (SEQ ID NO:946)
Q18297_8/1-30    YQLTPLHYAA  MK-----SNF  SALHALIKLK  A----DVDA  (SEQ ID NO:947)
O24538_2/1-32    NGNTALWYAI  AS-----KHY  SIFRILYQLS  AL--SDPYT  (SEQ ID NO:948)
O55014_3/1-30    LLSTALHVAV  RT-----GHY  ECAEHLIACE  A----DLNA  (SEQ ID NO:949)
O45398_3/1-33    QGASALEIAL  CSE--HEKSR  QIAAQLVEKG  A----DVNV  (SEQ ID NO:950)
O17055_5/1-30    VHFTALHCAT  YF-----GQE  NAVRTLISAS  A----NLNL  (SEQ ID NO:951)
O15084_21/1-30   LKRTPIHAAA  TN-----GHS  ECLRLLIGNA  E----PQNA  (SEQ ID NO:952)
O88849_14/1-33   EGKIPLHWAA  NHK--DPSAV  HTVRCILDAA  P----TESL  (SEQ ID NO:953)
Q02989_13/1-30   RNEYPFYLAV  EK-----RYK  DIFDYFVSKD  A----NVNE  (SEQ ID NO:954)
O23295_1/1-30    YGVSSLFVAI  NT-----GDV  SLVKAILKII  G----NKDL  (SEQ ID NO:955)
Q14349_5/1-30    EENICLHWAS  FT-----GSA  AIAEVLLNAR  C----DLHA  (SEQ ID NO:956)
Q12013_1/1-30    RGFNALHCAL  VG-----GDQ  RVICDLILSG  A----NFYE  (SEQ ID NO:957)
Q40785_2/1-30    DDESIVHHTA  SV-----GDA  EGLKKALDGG  A----DKDE  (SEQ ID NO:958)
DAPK_HUMAN_5/1-  GGSNAVYWAA  RH-----GHV  DTLKFLSENK  C----PLDV  (SEQ ID NO:959)
O18270_6/1-34    RDRSPLHYAA  CK-----VNL  EALRILLFVD  PNGGPDFGF  (SEQ ID NO:960)
Q86916_3/1-30    RYCNPLFYYV  EQ-----DD   VKKWIKFV    N----DCND  (SEQ ID NO:961)
```

```
AKR_ARATH_2/1-3    GGLTALHRAI IG-----KKQ AITNYLLRES A----NPFV   (SEQ ID NO:962)
O16004_2/1-31      MGETPLHAAV RA-----DAI EVFRLLIQNR ST---QIDA   (SEQ ID NO:963)
O16004_3/1-41      DGLTPLMLAV MR(10)ETHA HFIEDLITRG G----DINH   (SEQ ID NO:964)
YA2A_SCHPO_4/1-    QGFNCLHLAV HA-----ASP LLVVYLLHLD I----SVDL   (SEQ ID NO:965)
Q18297_9/1-30      EKKTPLRMAV EG-----NHP ETLKKILQME K----KNSC   (SEQ ID NO:966)
O35433_1/1-31      KGLTPLALAA SS-----GKI GVLAYILQRE IH---EPEC   (SEQ ID NO:967)
O54807_8/1-30      KGNPPLWLAL AS-----NLE DIASTLVRHG C----DATC   (SEQ ID NO:968)
P87603_3/1-40      TYLSRLCIVN KN(8)NNINI EVVKYLIRSG S----DISL   (SEQ ID NO:969)
O73579_3/1-30      SLPIQYYWSC ST-----IDI EIVKLLIKDV D----TCRV   (SEQ ID NO:970)
Q21587_6/1-33      RLKSPFVEYF RSN--DSIDA KVVKLFITHG A----KVVM   (SEQ ID NO:971)
A53950_3/1-30      FDKSAFDIAM EK-----NNT EILVMLQEAM Q----NQVN   (SEQ ID NO:972)
Q18663_3/1-31      SGRTPFDLAC EY-----GQE KMLERLFSCG LR---KINF   (SEQ ID NO:973)
Q25328_11/1-31     NNITALHYAA IL-----GYL ETTKQLINLK EI---NANV   (SEQ ID NO:974)
O72760_2/1-36      EYKNILIHYI YS(4)KPINY YVLYKLLRKG A----DPNY   (SEQ ID NO:975)
Q89342_2/1-30      DGSTPLHFIA RW-----GRK ICARELITAG V----EINT   (SEQ ID NO:976)
O83807_9/1-30      MGSSALVLAI KK-----DRS DLCHELLALG A----DLFI   (SEQ ID NO:977)
Q83730_2/1-33      DGRYPLLCLL END--RINTA RFVRYMIDRG T----SVYV   (SEQ ID NO:978)
O04242_3/1-32      RLDLPVTLCF AVN---KGDD FMLHQLLKRG L----DPNE   (SEQ ID NO:979)
O82490_1/1-30      YGLSPLHLAI EE-----GQT RLVLSLLKVD S----DLVR   (SEQ ID NO:980)
O45398_4/1-30      DQFTPAHMAV SW-----AQN DVLRALRDHS A----NLCD   (SEQ ID NO:981)
P87600_4/1-35      NGVDPLMLTM ENNMLSGHQW YLVKNILDKR P----NVNM   (SEQ ID NO:982)
O73560_2/1-48      DGLTSLHYYC KH(17)RAEK RFIYTIIDHG A----NINA   (SEQ ID NO:983)
P87603_5/1-33      NIPEILYLYI QMA--QYVDL DVIKHFLNNS V----ILDY   (SEQ ID NO:984)
Q14678_3/1-29      DGSTALSIAL EA-----GHK DIAVLLYAHV -----NFAK   (SEQ ID NO:985)
Q93318_1/1-38      HGDTAVDLLC SS(6)NNVRE NLYIRLLTSG A----VPNK   (SEQ ID NO:986)
G3930525_6/1-30    YGMTPLLAAS VT-----GHT NIVEYLIQEQ P----GHEQ   (SEQ ID NO:987)
YB07_FOWPM_5/1-    SKRPCVTAMC YAI--QNNKI DMVSMFLKRG A----DSNI   (SEQ ID NO:988)
JQ1744_5/1-31      FGDTCVTLAV AT-----NHV YFVTAVLQHK PS---EQTI   (SEQ ID NO:989)
VB04_VACCC_2/1-    YGENILHTYS MD----DANT NIIIFFLDRV L----NINK   (SEQ ID NO:990)
O41154_3/1-35      YGKTCIEMAA YY-----GHQ DILKMMNGKL GI(4)IIND   (SEQ ID NO:991)
P87600_5/1-36      GDMDILYTYF NSPRTRCIKL DLIKYMVDVG IV---NLNY   (SEQ ID NO:992)
Q21920_17/1-31     DGVNCFMEVA RH-----GSI DLMSLLVEFT KG---NMPM   (SEQ ID NO:993)
O44997_6/1-30      NGATAMHCAA KY-----GHA EVFNYFHMKG G----NICA   (SEQ ID NO:994)
P72763_6/1-30      EGKTPLMLAA MA-----NLA AVITTIANYS V----QVNR   (SEQ ID NO:995)
Q09493_2/1-31      QGETPLTLAA GI----PNNR AVIVSLIGGG A----HVDF   (SEQ ID NO:996)
Q24145_1/1-30      FGCQPLHYAA RS-----KTA SFIRTLISAQ A----NVQG   (SEQ ID NO:997)
Q17583_2/1-31      NGVSPLMYAT TV-----RSI NSAKHLVLHR DS---DVNM   (SEQ ID NO:998)
O90757_6/1-30      HVKAPIHVAV ER-----NNI YGTMLLINRN A----DVNI   (SEQ ID NO:999)
MBP1_YEAST_1/1-    ELHTAFHWAC SM-----GNL PIAEALYEAG T----SIRS   (SEQ ID NO:1000)
O83807_10/1-30     GGNTPLHLAC EW-----KLT QAINGILRKG A----EIEA   (SEQ ID NO:1001)
G4103857_2/1-32    GLLTPLHLAA GN----RDSR DTLELLLMNR YI---KPEL   (SEQ ID NO:1002)
O18270_7/1-30      ESVTPLHIAA TK-----QDT KILKIFVEIL K----TPKV   (SEQ ID NO:1003)
O68219_2/1-31      GKKTTLTAEA LT----SGKY GVVKALIKNS A----DVNA   (SEQ ID NO:1004)
Q19995_4/1-30      TGSVALILAV LN-----GHK SIVEAILGYS L----NTLN   (SEQ ID NO:1005)
O45398_5/1-29      DGRTPAHIGV RE-----QNV DGVKILLDAE -----NVEF   (SEQ ID NO:1006)
Q12013_3/1-30      NNRTPLLWAA YQ-----GDF LTVELLLKFG S----TVAW   (SEQ ID NO:1007)
O18152_5/1-31      MGQTPLMLAA SQ-----GQL EAVQFLTKTA KA---DVDA   (SEQ ID NO:1008)
Q89540_4/1-32      YGRTTLHHLA RTA---KISE GMVRTLTGLG V----DPAA   (SEQ ID NO:1009)
Q17643_1/1-30      VDQTPLGVAV RS-----QSS ELIALLIAYG G----DVNL   (SEQ ID NO:1010)
Q63618_3/1-31      DGMTPLHAAA QM-----GHN PVLVWLVSFA DV---SFEQ   (SEQ ID NO:1011)
O14586_2/1-30      DFKSPLHKAA WN-----CDH VLMHMMLEAG A----EANL   (SEQ ID NO:1012)
Q17583_4/1-31      GNLTALSMAI VC----TPGV YMVRTLIDLG A----SVNK   (SEQ ID NO:1013)
O68219_3/1-32      TGTPALHLAT AA-----GNH RTAMLLLDKG AP--ATQRD   (SEQ ID NO:1014)
Q93318_2/1-31      DGDTPLHIVA AH-----NDL GKIYALCETL RK---TMNE   (SEQ ID NO:1015)
O54807_9/1-30      DGETALQLAI KH-----QLP LVVDAICTRG A----DMSV   (SEQ ID NO:1016)
Q01317_4/1-30      DNFTPLVHSI VR-----NHL ECVGRLLERS A----RIDP   (SEQ ID NO:1017)
O82490_2/1-30      FINTPLHIAS AS-----GNL SFAMELMNLK P----SFAR   (SEQ ID NO:1018)
YAHD_ECOLI_2/1-    TCLNPFLISC LN-----DDL TLLRIILPAK P----DLNC   (SEQ ID NO:1019)
Q63618_4/1-30      LDALPVHHAA RS-----GKL HCLRYLVEEV A----LPAV   (SEQ ID NO:1020)
Q89440_2/1-44      MEMYPRHRYS KH(13)DLDM NVVKELLSNG A----SLTI   (SEQ ID NO:1021)
P87601_1/1-38      DGYTCLDVAV DR(6)REAH    LEILLREP L----SIDC   (SEQ ID NO:1022)
```

```
O18152_8/1-31     HGRTCVHVVA  ST-----NDV  AAAKMLKRIG  GV---NFEA  (SEQ ID NO:1023)
1AP7_1/1-30       TGSLPIHLAI  RE-----GHS  SVVSFLAPES  D----LHHR  (SEQ ID NO:1024)
O17055_6/1-32     FSETPLHAAC  TG----GKSI  ELVSFLMKYP  GV---DPNY  (SEQ ID NO:1025)
Q18297_10/1-32    RLNTVFHIVA  LR-----GEP  EYLEMMMDHD  PV--EAIKA  (SEQ ID NO:1026)
157038_4/1-32     HGNTALHLSC  IA-----GEK  QCVRALTEKF  GA--TEIHE  (SEQ ID NO:1027)
O75762_9/1-30     DKKSPLHFAA  SY-----GRI  NTCQRLIQDI  S----DTRL  (SEQ ID NO:1028)
O23296_4/1-31     TGDSILHIAA  KW-----GHL  ELVKEIIFEC  PC---LLFE  (SEQ ID NO:1029)
TRI9_HUMAN_3/1-   DGDTALHLAV  IH-----QHE  PFLDFLLGFS  A----GTEY  (SEQ ID NO:1030)
Q23595_3/1-32     NGETAAHISA  AH-----GDM  RALEILLGGS  LK--STMNC  (SEQ ID NO:1031)
VC17_VACCC_2/1-   GGSLPIQYYW  SFS---TIDI  EIVKLLLIKD  V----DTCR  (SEQ ID NO:1032)
Q18297_11/1-30    YQKTPLQVAV  DS-----GKL  ETCQRLVAKG  A----QIES  (SEQ ID NO:1033)
NTC4_MOUSE_4/1-   AGRTPLHTAV  AA----DARE  VCQLLLASRQ  T----SVDA  (SEQ ID NO:1034)
O54807_10/1-30    KGRNFLHVAV  QN-----SDI  ESVLFLISVQ  A----NVNS  (SEQ ID NO:1035)
O68219_4/1-31     MGDTALHEAL  YSD---NVTE  KCFLKMLKES  R-----KHL  (SEQ ID NO:1036)
O18270_8/1-32     VGRTAVFWAC  MG-----GQA  HTLHCMIKEL  GF--EWRTS  (SEQ ID NO:1037)
O18152_9/1-31     DGAVALHYAV  TH-----DHV  ELVKHLTNQH  TV---EAKD  (SEQ ID NO:1038)
Q18297_12/1-30    DERTPVFIGA  KF-----NAL  SSVEYILDHL  R----KKNK  (SEQ ID NO:1039)
VC09_VACCC_4/1-   DGETPLKAYV  TKKN-NNIKN  DVVILLLSSV  D----YKNI  (SEQ ID NO:1040)
1AP7_2/1-29       FGKTALQVMM  F------GSP  AVALELLKQG  A----SPNV  (SEQ ID NO:1041)
P87600_6/1-35     LGYTPLTSYI  CTAQ-NYMYY  DIIDCLISNK  VL---NMVK  (SEQ ID NO:1042)
O75762_10/1-30    CHETMLHRAS  LF-----DHH  ELADYLISVG  A----DINK  (SEQ ID NO:1043)
P87603_6/1-35     YSSNIFSVYF  KAHNTIGIDI  KLVKWMITKG  V----DINY  (SEQ ID NO:1044)
O48738_5/1-30     MGETTLHVAA  RA-----GSL  NIVEILVRFI  T----ESSS  (SEQ ID NO:1045)
P87611_2/1-30     DFDIFEYIES  DN-----IDV  ELLRLLIAKG  L----EINS  (SEQ ID NO:1046)
Q25328_13/1-31    RGTTPFLTAV  AE-----NAL  HIAEYLIREK  RQ---DINI  (SEQ ID NO:1047)
Q02979_3/1-31     KSSSLLHLAT  EW-----NNY  PLLHVLLSSK  RF---DINY  (SEQ ID NO:1048)
Q01317_5/1-30     KDLPAMYYAA  WE-----GHL  ECMKLLTPAK  K----EKAA  (SEQ ID NO:1049)
Q17343_21/1-30    EGDEPEHHYT  ET-----TTT  TVTKEVIDDS  Q----EMGD  (SEQ ID NO:1050)
Q19995_6/1-31     DKIDGIHKSI  KE-----GNL  DKVKELMKTK  KL---AIAR  (SEQ ID NO:1051)
P90902_3/1-30     DGSTYLHVAS  AN-----GYY  DVAAFLLTCS  V----SPLI  (SEQ ID NO:1052)
O68219_5/1-34     YEPHPQHVAV  EAV--RTGAV  GVLEHLITTE  VI---SVNE  (SEQ ID NO:1053)
Q83730_3/1-30     LDFTPINYCV  IH-----NDR  RTFDYLLERG  A----DPNV  (SEQ ID NO:1054)
E1344043_2/1-30   FGYNALVCAV  KA-----KAM  DCIIAIRDAG  G----FIDA  (SEQ ID NO:1055)
O45398_8/1-31     YGENAMLCAV  RS-----GSL  DCIRAVADSS  RT---NRYA  (SEQ ID NO:1056)
Q12013_4/1-31     YVVDIFIEAA  KD-----GDL  KVVKDVVESG  AV---DINN  (SEQ ID NO:1057)
O24382_4/1-31     GDVGHFACVA  VE----QNNL  SLLKEIVRYG  G----DVTL  (SEQ ID NO:1058)
4151809_3/1-30    DGMTALHKAA  CA-----RHC  LALTALLDLG  G----SPNY  (SEQ ID NO:1059)
O73579_4/1-36     DESIVQAMLI  NY(4)DMVSI  PIVRCMLDNG  A----TMDK  (SEQ ID NO:1060)
NAFSPLHCAV        IN-----DNE  GAAEMLIDTL  GA--SIVNA             (SEQ ID NO:1061)
O15084_23/1-32    NGESLLTVAV  RS-----GNT  AVAKQLAQLD  PD---AIDE  (SEQ ID NO:1062)
Q20109_8/1-31     IRTSSLIEAM  KSR--QEDNV  TMMKNFLQHH  K----KLKD  (SEQ ID NO:1063)
O04703_2/1-33     SGMTPAMMCA  KR----SFTM  FPLRLIVRAG  A----DLSL  (SEQ ID NO:1064)
Q18970_1/1-31     DGISACHIAC  KD-----GMI  DHFNLLIYYH  A----DICL  (SEQ ID NO:1065)
Q18663_4/1-30     DGMIPVVYCI  HS(7)NITNI  KIIRKLLNLS  RH---APHN  (SEQ ID NO:1066)
O72755_3/1-40     NDRSAMHAVA  YR-----GNN  KIALRFLLKN  Q----SIDI  (SEQ ID NO:1067)
Q25338_10/1-30    EGNTVLLLAY  MK-----GNA  NLCRAIVRSG  V----RLGV  (SEQ ID NO:1068)
O54807_12/1-30    RGQTACHVAA  EA-----GAP  EILSKIVEAR  R----GLKW  (SEQ ID NO:1069)
O45398_10/1-30    NCNTALIYAA  ST----DGRD  VVREILMTEG  P----KKPD  (SEQ ID NO:1070)
Q21920_18/1-31    QLRNVLKLAA  LQ-----NQP  EVLELLLGLG  -----EQYD  (SEQ ID NO:1071)
Q21587_7/1-29     NGINIVEKYA  TTS---NPNV  DVFKLLLDKG  IP---TCSN  (SEQ ID NO:1072)
VC09_VACCC_5/1-   SNINDFDLSS  DN-----IDL  RLLKYLIVDK  RI(4)NTNY  (SEQ ID NO:1073)
VC17_VACCC_3/1-   SGCTCISEAV  AN-----NNK  IIMEVLLSKR  P----SLKI  (SEQ ID NO:1074)
VB04_VACCC_3/1-   QGYTPIHLAI  QG-----NHV  PLVAYFLLKF  EYA-KDISD  (SEQ ID NO:1075)
Q18970_2/1-33     NGFSALHQAV  SS-----DDR  ILMRGLQYEN  I----NVDV  (SEQ ID NO:1076)
Q23859_3/1-30     YDKTALDIAI  DA-----KFS  NIVEYLKTKS  G----KFRR  (SEQ ID NO:1077)
Q25328_14/1-30    YGMTPIHKAL  LH-----GQT  NTVRFLLGRF  P----SCVN  (SEQ ID NO:1078)
Q19995_7/1-30     YNETSIYDAV  SY-----NAY  NTLVYLLNRN  G----DFET  (SEQ ID NO:1079)
VB04_VACCC_4/1-   VLLPGLALAA  AH----AGDL  DTLQAFVELG  R----DLNL  (SEQ ID NO:1080)
O88202_1/1-31     ELPNPLHEAA  RR-----GNM  DMLAECLRER  V----SVNS  (SEQ ID NO:1081)
E1350208_1/1-30   ALYSPKKYSA  DVM---SEMA  QIAEALLQAG  A----NPNM  (SEQ ID NO:1082)
O54807_13/1-32    QQQHQLFSAV  EQ-----ND   VKKLSSKK    KISKSNLTS  (SEQ ID NO:1083)
Q23859_4/1-34
```

```
004242_4/1-31      -GDVALYSCV AVE----ENDP ELLENIIRYG G----NVNS   (SEQ ID NO:1084)
Q93203_3/1-30      SDFTLLHHAV LE-----NQN QISKLLMDYE P----LLLL   (SEQ ID NO:1085)
Q17583_5/1-30      LHITSLQIAS LL-----RVD DIIPLLLQRR A----DVTV   (SEQ ID NO:1086)
YIA1_YEAST_1/1-    KNFEELCYSC RT-----GDM DNVDRLISTG V----NVNS   (SEQ ID NO:1087)
O35433_2/1-30      FGELPLSLAA CT-----NQL AIVKFLLQNS W----QPAD   (SEQ ID NO:1088)
O83515_2/1-30      CFEENFIATV MD-----GNI DIVNLFLDAG F----SAAL   (SEQ ID NO:1089)
O23295_4/1-30      NGWTCLSLAA HI-----GYY EGVCNLLERS T----KAAE   (SEQ ID NO:1090)
AKR_ARATH_3/1-3    KKWLPLHTLA AC-----GEF YLVDSLLKHN L----DINA   (SEQ ID NO:1091)
Q83730_4/1-35      SRTSPLCTVL SNKDLGNEAE ALAKQLIDAG A----DVNA   (SEQ ID NO:1092)
O72760_5/1-43      RGNTFLHYFC IY(12)HREK KFIKELVKYG A----DINK   (SEQ ID NO:1093)
Q63618_7/1-32      NGATPAHDAA AT-----GYL SCLQWLLTQG GC--RVQEK   (SEQ ID NO:1094)
YG4X_YEAST_4/1-    FNQIPLHRAA SV-----GSL KLIELLCGLG KS---AVNW   (SEQ ID NO:1095)
G3786431_4/1-34    EGSTCLHWAA RC-----GSS ECVSTILNFP FPSEFIIEI   (SEQ ID NO:1096)
O73579_5/1-32      EGLTPLGAYS KHR---HVKY QIVHLLISSY S----NSSN   (SEQ ID NO:1097)
Q01317_6/1-32      ERVTRTFLAS IN----EGSL EALKVLLDTG LV---DIQS   (SEQ ID NO:1098)
O73579_6/1-33      DNNYPLHDYF VNN--NLVDV NVVRFIVENN G----HMAV   (SEQ ID NO:1099)
O83807_13/1-31     NQETPLFSAV KS-----DAA EVISILLHPQ AG---NPAL   (SEQ ID NO:1100)
LI12_CAEEL_4/1-    SERSALHQAA AN-----RDF GMMVYMLNST KLK-GDIEE   (SEQ ID NO:1101)
Q89202_3/1-30      LFIPDNKLAI DN-----KDI EMLQALFKYD I----NIYS   (SEQ ID NO:1102)
Q24241_22/1-34     DGNTALHIAS NLG--YVTVM ESLKIVTSTS VI---NSNI   (SEQ ID NO:1103)
Q93318_4/1-31      VGDSPLHFAT AR-----GMN NMVEALLSKR EI---RVNE   (SEQ ID NO:1104)
Q25328_17/1-32     HGRTVFHAAA KS-----GND KIMFGLTFLA KST--ELNQ   (SEQ ID NO:1105)
P70770_2/1-30      MAIVALMKAT RE-----GVD AVVKELIDLG V----DQAR   (SEQ ID NO:1106)
VB04_VACCC_5/1-    HGISLIKLYL ES(4)EIDNE HIVRHLIIFD AV---ESLDY   (SEQ ID NO:1107)
VB04_VACCC_6/1-    YGNTPFILLC KHD---INNV ELFEICLENA NI--DSVDF   (SEQ ID NO:1108)
O04704_2/1-34      YGDPNMYVNL LTVA-STGNA TFLEELLKAK L----DPDI   (SEQ ID NO:1109)
O45398_12/1-31     DSKTPFFNEI VS----RKDV ASVEALLAAN V----DCHV   (SEQ ID NO:1110)
TRPL_DROME_2/1-    KSYTRFWGLL MF(4)VINVI VLLNLLIAMM S----NSYA   (SEQ ID NO:1111)
JQ1744_6/1-32      YKRQVVEDYL RKR---YVKA DVLKTILDSG I----RLSK   (SEQ ID NO:1112)
Q84566_5/1-31      IRHNILFYHV IR-----DNY DVVKFIIDNK LV---DINE   (SEQ ID NO:1113)
O49409_2/1-30      WGSTPFADAI FY-----KNI DVIKILEIHG A----KHPM   (SEQ ID NO:1114)
JQ1744_7/1-35      SGHSAMMSYL INNPDATVHP EYVSYMVDCG A----NINQ   (SEQ ID NO:1115)
Q02979_4/1-30      GGWTPMEHAV LR-----GHL HIADMVQIRD E----LVTH   (SEQ ID NO:1116)
O24538_3/1-27      ----NLLCLAA KR-----NDL TVMNELLKQG L----NIDS   (SEQ ID NO:1117)
Q89202_4/1-30      GWKTSFYHAV ML-----NDV SIVSYFLSEI P----STFD   (SEQ ID NO:1118)
O83807_14/1-30     SGSTPLMVAV TE-----NCF ESVRMLIARD A----SLFS   (SEQ ID NO:1119)
G3786431_5/1-31    ECRTAMYLAV AE-----GHL EVVKAMTDFK CT---SIDG   (SEQ ID NO:1120)
O62398_2/1-27      TGNTVIHCAI --------NK KCLILLMEKF R----DQTD   (SEQ ID NO:1121)
Q25338_11/1-30     NHMAPIHFAA SM-----GSI KMLRYLISIK D----KVSI   (SEQ ID NO:1122)
Q23595_4/1-31      CKMLPVHVAA AQ-----GNI EFLRAAIKFD NQ---MVNA   (SEQ ID NO:1123)
Q25328_18/1-30     NGQMPIHGAA MT-----GLL DVAQAIISID A----TVVD   (SEQ ID NO:1124)
Q28282_5/1-31      KYDDRLMKAA ER----GDVE KVSSILAKKG I----NPGK   (SEQ ID NO:1125)
Q94527_4/1-29      NRDTLLHEVI SH------KK DKLKLAIQTI Q---VMNY   (SEQ ID NO:1126)
AKR1_YEAST_5/1-    PLLTRYHTAC QR-----GDL ATVKEMIHGK LL--EVNN   (SEQ ID NO:1127)
391941_4/1-31      SSDLDLHLTL DD-----IDE KITHQRLQEN KA--AFFF   (SEQ ID NO:1128)
Q23595_5/1-30      DRANAIHCAA YS-----GSV PVLSHLLNAF S----KKKR   (SEQ ID NO:1129)
P87603_8/1-29      SGMTAFHVAV C------LRK DAMKYLLSIG Y----SIDK   (SEQ ID NO:1130)
O72755_4/1-42      QMRTPLHKYL CK(11)YYNE KIIDAFIELG A----DLTI   (SEQ ID NO:1131)
O18270_9/1-31      IGATPAHYAA Q------FSV ECLKILFAES KI--TEVND   (SEQ ID NO:1132)
Q90623_5/1-31      EGDTPLDIAE EE-----AME ELLQNEVNRQ GV---DIEA   (SEQ ID NO:1133)
O61222_7/1-30      QTETPLHVAA RA----GRAV NCTFLMKEML -----DLEK   (SEQ ID NO:1134)
JQ1744_9/1-33      RGHTPLLVYI TMG---LFIES DAITCMIDHG A----DPLV   (SEQ ID NO:1135)
P87621_5/1-32      NNYHILHAYC GIK---GLDE RFVEELLHIG Y----SPNE   (SEQ ID NO:1136)
O16229_1/1-32      DGKNAILDAV RE----RNKP NLLKALQNGA FV---DVYN   (SEQ ID NO:1137)
VB18_VARV_5/1-3    NNKHAIQLII DNKENSQYTI DCLLYILRYI V----DKNV   (SEQ ID NO:1138)
O90757_7/1-30      KHFNMLRKAV LN-----HDH NLVNIFIDKN F----NINI   (SEQ ID NO:1139)
Q93318_5/1-32      TGKTIVHHAV DKM--DVELL DFLKTVVNED -----TFTE   (SEQ ID NO:1140)
Q21920_19/1-31     ERDSALTLSA QK-----GHI KIVTAIMDYY EK---NPPQ   (SEQ ID NO:1141)
Q02989_18/1-31     ERKTFFDLAI EN-----GRL NIVAFAVEKN KV---NLQA   (SEQ ID NO:1142)
A55839_4/1-31      GGRTPLGSAL LR-----PNP ILARLLRAHG AP---EPED   (SEQ ID NO:1143)
O60733_5/1-31      KGETVFHYAV QG-----DN  LQLLGRNA VA---GLNQ    (SEQ ID NO:1144)
```

```
O83807_16/1-31      AGESILHYAA KV-----ADE KTLQGLLAMN RF---GKFL        (SEQ ID NO:1145)
O75762_11/1-30      QQASFLHLAL HN-----KRK EVVLTIIRSK R----WDEC        (SEQ ID NO:1146)
391941_5/1-30       VQFDPLNVAC KF-----NNH DAAKLLLEIR S----KQNA        (SEQ ID NO:1147)
Q94447_2/1-30       KSFTRFWALL MF-----GSY SVINIIVLLN M----LIAM        (SEQ ID NO:1148)
Q18104_2/1-33       TIFEVLAWCN ETV--KQNDF DVMETALDSL N----NLNL        (SEQ ID NO:1149)
O48738_6/1-31       SGKSVIHAAM KA-----NRR DILGIVLRQD PG---LIEL        (SEQ ID NO:1150)
O61222_8/1-46       FNRTALHYAF GN(13)SDPI AVVSLLSSLI RP--EQIEI        (SEQ ID NO:1151)
O73579_8/1-30       RFNNCGYHCY ET-----ILI DVFDILSKYM D----DIDM        (SEQ ID NO:1152)
O23296_6/1-31       QGNKHLAHVA LK----AKSI GVLDVILDEY P----SLMD        (SEQ ID NO:1153)
Q09493_4/1-30       HGNHEIHQAC KN-----GLT KHVEHLLYFG G----QIDA        (SEQ ID NO:1154)
Q83730_5/1-34       YGFNVLQCYM IAHV-RSSNV QILRFLLRHG V----DSSR        (SEQ ID NO:1155)
Q91974_4/1-34       DGDTFLHLAI IHEE-KALSL EVIRQAAGDA A----FLNF        (SEQ ID NO:1156)
O61240_6/1-32       MDRLPRDIAN ER-----LHT DIVQLLDEYN LV--RSPNL        (SEQ ID NO:1157)
Consensus/60%       psp*sLabAs pp.....spb chlcbLlpps s....shsh
```

Table 11 Alignment of Armadillo Repeat Sequences

```
IMO2HUMANb    PND-KIQAVI DAG--VCRRL VELLM----- -HNDYKVVSP ALRAVGNIVT    (SEQ ID NO:1158)
MMU34228c     PND-KIQAVI DAG--VCRRL VELLM----- -HNDYKVVSP ALRAVGNIVT    (SEQ ID NO:1159)
cATAF00130    SND-KIQAVI EAG--VVPRL IQLLG----- -HSSPSVLIP ALRTIGNIVT    (SEQ ID NO:1160)
cATKAPAPRO    SND-KIQAVI EAG--VVPRL IQLLG----- -HSSPSVLIP ALRTIGNIVT    (SEQ ID NO:1161)
ATU69533d     TND-KIQTVI QAG--VVPKL VELLL----- -HHSPSVLIP ALRTVGNIVT    (SEQ ID NO:1162)
AB002533c     GNE-QIQMVI DSG--IVPHL VPLLS----- -HQEVKVQTA ALRAVGNIVT    (SEQ ID NO:1163)
HSSRP11a      GNE-QIQMVI DSG--IVPHL VPLLS----- -HQEVKVQTA ALRAVGNIVT    (SEQ ID NO:1164)
HSSRP1Bc      GNE-QIQMVI DSG--VVPFL VPLLS----- -HQEVKVQTA ALRAVGNIVT    (SEQ ID NO:1165)
CELF32E10c    GNE-HIQMVI EAQ--VVTHL VPLLG----- -HVDVKVQTA ALRAVGNIVT    (SEQ ID NO:1166)
SRP1YEASTd    PQE-AIQAVI DVR--IPKRL VELLS----- -HESTLVQTP ALRAVGNIVT    (SEQ ID NO:1167)
IMO1HUMANc    PNE-RIGMVV KTG--VVPQL VKLLG----- -ASELPIVTP ALRAIGNIVT    (SEQ ID NO:1168)
bATAF00130    TSE-NTNVII ESG--AVPIF IQLLS----- -SASEDVREQ AVWALGNVAG    (SEQ ID NO:1169)
bATKAPAPRO    TSE-NTNVII ESG--AVPIF IQLLS----- -SASEDVREQ AVWALGNVAG    (SEQ ID NO:1170)
SLU96718b     TSD-HTAVVI EQG--AVPIF VQLLS----- -SPSDDVREQ AVWALGNVAG    (SEQ ID NO:1171)
ATU69533b     TSD-HTKVVI DHN--AVPIF VQLLA----- -SPSDDVREQ AVWALGNVAG    (SEQ ID NO:1172)
IMO2HUMANc    NSL-QTRIVI QAR--AVPIF IELLS----- -SEFEDVQEQ AVWALGNIAG    (SEQ ID NO:1173)
MMU34228a     NSL-QTRNVI QAG--AVPIF IELLS----- -SEFEDVQEQ AVWALGNIAG    (SEQ ID NO:1174)
AB002533b     TSE-QTQAVV QSN--AVPLF LRLLH----- -SPHQNVCEQ AVWALGNIIG    (SEQ ID NO:1175)
HSSRP1Bb      TSA-QTQAVV QSN--AVPLF LRLLR----- -SPHQNVCEQ AVWALGNIIG    (SEQ ID NO:1176)
CELF32E10b    TSE-QTQAVV NAG--AVPLF LQLLS----- -CGNLNVCEQ SVWALGNIIG    (SEQ ID NO:1177)
IMO1HUMANa    TSE-QTKAVV DGG--AIPAF ISLLA----- -SPHAHISEQ AVWALGNIAG    (SEQ ID NO:1178)
SRP1YEASTb    TSA-QTKVVV DAD--AVPLF IQLLY----- -TGSVEVKEQ AIWALGNVAG    (SEQ ID NO:1179)
CEF53B24      SQE-VTHLFV NSN--CLDIL IKLVR----- SQ-NARLSSQ TVWAIANIAA    (SEQ ID NO:1180)
CELF26B13b    STE-QTIAAV EAG--VTIPL IHLSV----- HQ-SAQISEQ ALWAVANIAG    (SEQ ID NO:1181)
AB002533a     RNP-PIDDLI KSG--ILPIL VHCLE----- RDDNPSLQFE AAWALTNIAS    (SEQ ID NO:1182)
HSSRP1Ba      RNP-PIDDLI KSG--ILPIL VKCLE----- RDDNPSLQFE AAWALTNIAS    (SEQ ID NO:1183)
CELF32E10a    RNP-PIDDLI GSG--ILPVL VQCLS----- -STDPNLQFE AAWALTNIAS    (SEQ ID NO:1184)
CELF26B13a    KNP-PIDEVI HCG--LLQAL VQALS----- -VENERVQYE AAWALTNIVS    (SEQ ID NO:1185)
aATAF00130    QNP-PINEVV QSG--VVPRV VKFLS----- RDDFPKLQFE AAWALTNIAS    (SEQ ID NO:1186)
aATKAPAPRO    QNP-PINEVV QSG--VVPRV VKFLS----- RDDFPKLQFE AAWALTNIAS    (SEQ ID NO:1187)
ATU69533a     RSP-PIEEVI SAG--VVPRF VEFLK----- KEDYPAIQFE AAWALTNIAS    (SEQ ID NO:1188)
SLU96718a     RSP-PIEEVI AAG--VVPRL VQFLQ----- RTDYPQLQFE AAWALTNIAS    (SEQ ID NO:1189)
IMO2HUMANa    PNP-PIDEVI STPG-VVARF VEFLK----- RKENCSLQFE SAWVLTNIAS    (SEQ ID NO:1190)
SRP1YEASTa    HRP-PIDVVI QAG--VVPRL VEFMR----- ENQPEMLQLE AAWALTNIAS    (SEQ ID NO:1191)
IMO1HUMAN1    KQP-PIDNII RAG--LIPKF VSFLGRT--- --DCSPIQFE SAWALTNIAS    (SEQ ID NO:1192)
AB002533e     NQQ-QVQAVI DAN--LVPMI IHLLD----- -KGDFGTQKE AAWAISNLTI    (SEQ ID NO:1193)
HSSRP11c      NQQ-QVQAVI DAN--LVPMI IHLLD----- -KGDFGTQKE AAWAISNLTI    (SEQ ID NO:1194)
CELF32E10e    NQQ-QVQDVF DAG--IMPMI IHLLD----- -RGDFPTQKE AAWAISNVTI    (SEQ ID NO:1195)
IMO2HUMANf    NRA-QIQTVI DAN--IFPAL ISILQ----- -TAEFRTRKE AAWAITNATS    (SEQ ID NO:1196)
MMU34228e     NRA-QIQTVI DAN--MFPAL ISILQ----- -TAEFRTRKE AAWAITNATS    (SEQ ID NO:1197)
eATAF00130    NAD-QIQAVI DAG--IIQSL VWVLQ----- -SAEFEVKKE AAWGISNATS    (SEQ ID NO:1198)
ATU69533f     NKD-QIQTVV EAN--LISPL VSLLQ----- -NAEFDIKKE AAWAISNATS    (SEQ ID NO:1199)
SRP1YEASTf    NTE-QIQAVI DAN--LIPPL VKLLE----- -VAEYKTKKE ACWAISNASS    (SEQ ID NO:1200)
IMO1HUMANe    RQD-QIQQVV NHG--LVPFL VSVLS----- -KADFKTQKE AVWAVTNYTS    (SEQ ID NO:1201)
CELF26B13e    TQK-QIQAVL DAN--LLPVL INVLK----- -SGDHKCQFE ASWALSNLAQ    (SEQ ID NO:1202)
AB002533d     TDE-QTQVVL NCD--ALSHF PALLT----- -HPKEKINKE AVWFLSNITA    (SEQ ID NO:1203)
HSSRP11b      TDE-QTQVVL NCD--ALSHF PALLT----- -HPKEKINKE AVWFLSNITA    (SEQ ID NO:1204)
CELF32E10d    TDE-QTQLVL DSG--VLRFM PGLLAH---- -YKEKINKE  AVWFVSNITA    (SEQ ID NO:1205)
IMO1HUMANd    TDE-QTQVVI DAG--ALAVF PSLLT----- -NPKTNIQKE ATWTMSNITA    (SEQ ID NO:1206)
IMO2HUMANe    DDI-QTQVIL NCS--ALQSL LHLLS----- -SPKESIKKE ACWTISNITA    (SEQ ID NO:1207)
MMU34228d     DDI-QTQVIL NCS--ALQSL LHLLS----- -SPKESIKKE ACWTISNITA    (SEQ ID NO:1208)
dATAF00130    DDL-QTQMVL DQQ--ALPCL LNLLKNN--- -YKKSIKKE  ACWTISNITA    (SEQ ID NO:1209)
ATU69533e     DDI-QTQCVI NSG--ALPCL ANLLTQN--- -HKKSIKKE  ACWTISNITA    (SEQ ID NO:1210)
SRP1YEASTe    NDL-QTQVVI NAG--VLPAL RLLLS----- -SPKENIKKE ACWTISNITA    (SEQ ID NO:1211)
CELF26B13d    NDS-LTQAVI DLG--SLDEI LPLME----- KTRSSSIVKE CCWLVSNIIA    (SEQ ID NO:1212)
CRU40057b     SPE-LAQSVI DSG--ALDSL VTCL------ EEFDPGVKEA SAWTLGYIAG    (SEQ ID NO:1213)
CRU40057e     SET-LALSVI AEK--ALPPL VSALN----- EEPEDHLKSA TAWTLGQIGR    (SEQ ID NO:1214)
CRU40057d     TPE-LAQAVV DAG--AVAYL APLVI----- -NQDAKLKRQ VCCALSQIAK    (SEQ ID NO:1215)
CRU40057c     NAD-VAQQVV DAG--AVPLL VLCVQ----- -EPELSLKRI AASALSDISK    (SEQ ID NO:1216)
CTNBMOUSEk    DVH-NRIVIR GLN--TIPLF VQLLY----- -SPIENIQRV AAGVLCEIAQ    (SEQ ID NO:1217)
JC4835h       EAL-NRSIIR DLN--CIPTF VQLLY----- -SEVENIVRV AAGVLCEIAQ    (SEQ ID NO:1218)
CTNBMOUSEj    CPA-NHAPLR EQG--AIPRL VQLLVR(20) GVRMEEIVEG CTGALHILAR    (SEQ ID NO:1219)
HSPLGLNj      CPA-NHAPLQ EAA--VIPRL VQLLVK(19) GVRMEEIVEG CTGALHILAR    (SEQ ID NO:1220)
JC4835g       CPS-NHTPIR DQG--GLPKL VQLLMK(17) GVRMEEIVEG TVGALHILAR    (SEQ ID NO:1221)
HSP0071a      DNK-VKMEVC RLG--GIKHL VDLLD     -HRVLEVQKN ACGALRNLVF    (SEQ ID NO:1222)
```

| | | | | |
|---|---|---|---|---|
| HSU96136a | DNK-IKAEIR | RQG--GIQLL | VDLLD----- | -HRMTEVHRS | ACGALRNLVY | (SEQ ID NO:1223) |
| HSU51269a | NEG-VKRRVR | QLR--GLPLL | VALLD----- | -HPRAEVRRR | ACGALRNLSY | (SEQ ID NO:1224) |
| P120MOUSEa | NDK-VKTDVA | KLK--GIPIL | VGLLD----- | -HPKKEVHLG | ACGALKNISF | (SEQ ID NO:1225) |
| S60712a | DES-AKQQVY | QLG--GICKL | VDLLR----- | -SPNQNVQQA | AAGALRNLVF | (SEQ ID NO:1226) |
| HSRNAUa | KSE-ARKRVN | QLR--GILKL | IQLLK----- | -VQNEDVQNA | VCGALRNLVF | (SEQ ID NO:1227) |
| CTNBMOUSEh | NYK-NKMMVC | QVG--GIEAL | VRTVLRA--- | -GDREDITEP | AICALRHLTS | (SEQ ID NO:1228) |
| JC4835e | NPR-NKQVVF | QVG--GIEAL | VRTIINA--- | -GDREEITEP | AVCALRHLTS | (SEQ ID NO:1229) |
| YEB3YEASTb | NNE-NKLLIV | EMG--GLEPL | INQMM----- | -GDNVEVQCN | AVGCITNLAT | (SEQ ID NO:1230) |
| YEB3YEASTf | HPL-NEGLIV | DAG--FLKPL | VRLLD----- | YKDSEEIQCH | AVSTLRNLAA | (SEQ ID NO:1231) |
| P120MOUSEb | DQD-NKIAIK | NCD--GVPAL | VRLLRK---- | -ARDMDLTEV | ITGTLWNLSS | (SEQ ID NO:1232) |
| HSU51269b | DTD-NKAAIR | DCG--GVPAL | VRLLRA---- | -ARDNEVREL | VTGTLWNLSS | (SEQ ID NO:1233) |
| HSP0071b | TDE-NKIAMK | NVG--GIPAL | LRLLRK---- | -SIDAEVREL | VTGVLWNLSS | (SEQ ID NO:1234) |
| HSU96136b | NDD-NKIALK | NCG--GIPAL | VRLLRK---- | -TTDLEIREL | VTGVLWNLSS | (SEQ ID NO:1235) |
| S60712b | STT-NKLETR | RQN--GIREA | VSLLR----- | RTGNAEIQKQ | LTGLLWNLSS | (SEQ ID NO:1236) |
| HSRNAUb | DND-NKLEVA | ELN--GVPRL | IQVLK----- | QTRDLETKKQ | ITGLLWNLSS | (SEQ ID NO:1237) |
| HSU96136c | SVY-IRAAVR | KEK--GRPIL | VELLR----- | -IDNDRVACA | VATALRNMAL | (SEQ ID NO:1238) |
| HSP0071c | AAY-IRGGRP | KRK--GLPIL | VELLR----- | -MDNDRVVSS | GATALRNMAL | (SEQ ID NO:1239) |
| HSU51269c | ATY-IRATVR | KER--GLPVL | VELLQ----- | -SETDKVVRA | VAIALRNLSL | (SEQ ID NO:1240) |
| P120MOUSEc | GRY-IRSALR | QEK--ALSAR | AELLT----- | -SEHERVVKA | ASGALRNLAV | (SEQ ID NO:1241) |
| CTNBMOUSEi | AEM-AQNAVR | LHY--GLPVV | VKLLH----- | PPSHWPLIKA | TVGLIRNLAL | (SEQ ID NO:1242) |
| JC4835f | AEH-AENGVR | LHY--GIPIL | VKLLN----- | PPSRWPLIKA | VVGLIRNLGL | (SEQ ID NO:1243) |
| CTNBMOUSEc | HRE-GLLAIF | KSG--GIPAL | VKMLG----- | -SPVDSVLFY | AITTLHNLLL | (SEQ ID NO:1244) |
| JC4835a | HRQ-GLMAIF | KCS--GIPAL | VKLLG----- | -HRIEAVVFY | AITTLHNLLL | (SEQ ID NO:1245) |
| JC6161b | DDS-CAALLA | KSG--IIPAL | IELLN----A | QQEDDEFVCQ | IIYVFYQMVF | (SEQ ID NO:1246) |
| HSU59919b | DDS-CAALLA | KSG--IIPAL | IELLN----A | QQEDDEFVCQ | IIYVFYQMVF | (SEQ ID NO:1247) |
| SPU38655b | DDS-CAAMLA | KSG--IIQSL | IELLN----A | KQEDDEIVCQ | IVYVFYQMVF | (SEQ ID NO:1248) |
| CTNBMOUSEf | CSS-NKPAIV | EAG--GMQAL | GLHLT----- | -DPSQRLVQN | CLWTLRNLSD | (SEQ ID NO:1249) |
| JC4835d | CSS-NKPAIV | EAG--GMQAL | AHYLS----- | -HQSTRLVQN | CLWTLRNLSD | (SEQ ID NO:1250) |
| CELC54D15 | SNF-DAPNLV | AFG--GRQIL | ANLLS----- | -HGSPRLVQS | TLETLRNISD | (SEQ ID NO:1251) |
| APCHUMAc | DVA-NKATLC | SMKG-CMRAL | VAQL------ | KSESEDLQQV | IASVLRNLSW | (SEQ ID NO:1252) |
| XLU64442c | DVA-NKATLC | SMKS-CMRAL | VAQL------ | KSESEDLQQV | IASVLRNLSW | (SEQ ID NO:1253) |
| DMU77947c | DEN-NKALLC | GQKQ-FMEAL | VAQL------ | DSAPDDLLQV | TASVLRNLSW | (SEQ ID NO:1254) |
| JC6161a | FME-NKNDMV | EMD--IVEKL | VKMIP----- | -CEHEDLLNI | TLRLLLNLSF | (SEQ ID NO:1255) |
| HSU59919a | FME-NKNDMV | EMD--IVEKL | VKMIP----- | -CEHEDLLNI | TLRLLLNLSF | (SEQ ID NO:1256) |
| SPU38655a | YVE-NKNEMA | EQQ--IIERL | AKLVP----- | -CDHEDLLNI | TLRLLLNLSF | (SEQ ID NO:1257) |
| CTNBMOUSEd | QEG-AKMAVR | LAG--GLQKM | VALLN----- | -KTNVKFLAI | TTDCLQILAY | (SEQ ID NO:1258) |
| JC4835b | QEG-AKMAVR | LAL--GLQKM | VSLLQ----- | -RPKVKFLAI | VTDCLQILAY | (SEQ ID NO:1259) |
| CTNBMOUSEe | NQE-SKLIIL | ASG--GPQAL | VNIMR----- | TYTYEKLLWT | TSRVLKVLSV | (SEQ ID NO:1260) |
| JC4835c | NQE-SKLIIL | SSG--GPAEL | VRIMR----- | SYTYEKLLYT | TCRVLKVLSV | (SEQ ID NO:1261) |
| HSP0071d | NME-NAKALA | DSG--GIEKL | VNITKGRG-- | DRSSLKVVKA | AAQVLNTLWQ | (SEQ ID NO:1262) |
| HSU96136d | NME-NAKALR | DAG--GIEKL | VGISKSKGD- | -KHSPKVVKA | ASQVLNSMWQ | (SEQ ID NO:1263) |
| IMO1HUMANb | NPA-PPIDAV | EQ---ILPTL | VRLLH----- | -HDDPEVLAD | TCWAISYLTD | (SEQ ID NO:1264) |
| ATU69533c | KPQ-PHFDQV | KP---ALPAL | ERLIH----- | -SDAEEALTD | ACWALSYLSD | (SEQ ID NO:1265) |
| CELF32E10- | DPA-PSPAVV | RT---ILPAL | SLLIHHQ--- | ---DTNILID | TVWALSYLTD | (SEQ ID NO:1266) |
| AB002533z | DPP-PPMETI | QE---ILPAL | CVLIHHT--- | ---DVNILVD | TVWALSYLTD | (SEQ ID NO:1267) |
| IMO2HUMAN- | DST-MCRDYV | LDCN-ILPPL | IQLFSK---- | -QNRLTMTRN | AVWALSNLCR | (SEQ ID NO:1268) |
| MMU34228b | DST-MCRDYV | LNCN-ILPPL | IQLFSK---- | -QNRLTMTRN | AVWALSNLCR | (SEQ ID NO:1269) |
| SRP1YEASTc | DST-DYRDYV | LQCN-AMEPI | LGLFN----- | -SNKPSLIRT | ATWTLSNLCR | (SEQ ID NO:1270) |
| IMOB_RAT | EPN-QLKPLV | IQ---AMPTL | IELMKDP--- | ---SVVVRDT | TAWTVGRICE | (SEQ ID NO:1271) |
| HUMNTF9 | EPS-QLKPLV | IQ---AMPTL | IELMKDP--- | ---SVVVRDT | AAWTVGRICE | (SEQ ID NO:1272) |
| APCHUMANe | NED-HRQILR | ENN--CLQTL | IQHLK----- | -SHSLTIVSN | ACGTLWNLSA | (SEQ ID NO:1273) |
| XLU64442d | NED-HRQILR | ENN--CLQTL | IQHLK----- | -SHSLTIVSN | ACGTLWNLSA | (SEQ ID NO:1274) |
| DMU77947d | CEP-YRQILR | QHN--CIAIL | LQQLK----- | -SESLTVVSN | SCGTLWNLSA | (SEQ ID NO:1275) |
| APCHUMANb | DEE-HRHAMN | ELG--GLQAI | AELLQV(8)N | DHYSITLRRY | AGMALTNLTF | (SEQ ID NO:1276) |
| XLU64442b | DEE-HRHAMN | ELG--GLQAI | AELLQV(8)N | DHYSVTLRRY | AGMALTNLTF | (SEQ ID NO:1277) |
| DMU77947b | DEE-HRHAMC | ELG--ALHAI | PNLVHL(10) | DQCCNSLRRY | ALMALTNLTF | (SEQ ID NO:1278) |
| fATAF00130 | THD-QIKFMV | SQG--CIKPL | CDLLT----- | -CPDLKVVTV | CLEALENILV | (SEQ ID NO:1279) |
| dATKAPAPRO | THD-QIKFMV | SQG--CIKPL | CDLLT----- | -CPDLKVVTV | CLEALENILV | (SEQ ID NO:1280) |
| ATU69533g | SHD-QIKYLV | EQG--CIKPL | CDLLV----- | -CPDPRIITV | CLEGLENILK | (SEQ ID NO:1281) |
| IMO2HUMANg | SAE-QIKYLV | ELG--CIKPL | CDLLT----- | -VMDSKIVQV | ALNGLENILR | (SEQ ID NO:1282) |
| MMU34228f | SAE-QIKYLV | ELG--CIKPL | CDLLT----- | -VMDAKIVQV | ALNGLENILR | (SEQ ID NO:1283) |
| SRP1YEASTg | RPD-IIRYLV | SQG--CIKPL | CDLLEIA--- | ---DNRIIEV | TLDALENILK | (SEQ ID NO:1284) |
| IMO1HUMANf | TVE-QIVYLV | HCG--IIEPL | MNLLT----- | -AKDTKIILV | ILDAISNIFQ | (SEQ ID NO:1285) |
| AB002533f | RKD-QVAYLI | QQN--VIPPF | CNLLT----- | -VKDAQVVQV | VLDGLSNILK | (SEQ ID NO:1286) |
| HSSRPL1d | RKD-QVAYLI | QQN--VIPPF | CNLLT----- | -VKDAQVVQV | VLDGLSNILK | (SEQ ID NO:1287) |
| CELF32E10g | RPN-QVEQMV | KLG--VLRPF | CAMLSCT--- | ---DSQIIQV | VLDGINNILK | (SEQ ID NO:1288) |
| APCHUMANa | SQD-SCISMR | QSG--CLPLL | IQLLHG | SRGSKEARAR | ASAALHNIIH | (SEQ ID NO:1289) |
| XLU64442a | SQD-SCIAMR | QSG--CLPLL | IQLLH | SRGSKEARAS | GSAALDNIIH | (SEQ ID NO:1290) |

| | | | | | | |
|---|---|---|---|---|---|---|
| DMU77947a | NAQ-SCA_TLR_ | RSG--CMPLL | VQMMH-----A | PDNDQEVRKC | AEQALHNVVH | (SEQ ID NO:1291) |
| CTNBMOUSE1 | DKE-AAEA_IE_ | AEG--ATAPL | TELLH------ | -SRNEGVATY | AAAVLFRMSE | (SEQ ID NO:1292) |
| JC48351 | DKE-GADA_IE_ | REG--ATTIL | TELLH------ | -SRNDGIAAY | ARAVLFRMSE | (SEQ ID NO:1293) |
| CELF08F8 | FDE-NKI_VME_ | QNG--TIEKL | LKLFP------ | -IQDPELRKA | VIMLLFNFSF | (SEQ ID NO:1294) |
| GDS1HUMANc | RNDANCI_HMV_ | DNG--IVEKL | MDLLDRHVE- | -DGNVTVQHA | ALSALRNLAI | (SEQ ID NO:1295) |
| AT81KBGEN4 | NDR-NKKI_TV_ | DEG--GVSPL | LRLLK------ | ESSSAEGQIA | AATALGLIAC | (SEQ ID NO:1296) |
| S51350 | PDKVQRTYYV | HQ----ALPSI | LNLMNDQ--- | ---SLQVKET | TAWCIGRIAD | (SEQ ID NO:1297) |
| CELF26B13c | PDE-QIELAR | ESG--VLPHV | VAFF------ | -KEAENLVAP | ALRTLGNVAT | (SEQ ID NO:1298) |
| HSU51269d | DSLDNARS_LL_ | QAR--GVPAL | VALVA----- | SSQSVREAKA | ASHVLQTVWS | (SEQ ID NO:1299) |
| CELF26B13- | SSQLRDY_VIK_ | CHG---VEAL | MHLMEKV--- | DQLGDSHVRT | IAWAFSNMCR | (SEQ ID NO:1300) |
| YEB3YEASTd | SEE-NRKE_LV_ | NAG--AVPVL | VSLLS------ | -STDPDVQYY | CTTALSNIAV | (SEQ ID NO:1301) |
| GDS1HUMANa | KNEFMRIPCV | DAG--LISPL | VQLLN----- | -SKDQEVLLQ | TGRALGNICY | (SEQ ID NO:1302) |
| YEB3YEASTe | SDTSYQLE_IV_ | RAG--GLPHL | VKLIQ----- | -SDSIPLVLA | SVACIRNISI | (SEQ ID NO:1303) |
| CTNBMOUSEa | NYQDDAELAT | R----AIPEL | TKLLN----- | -DEDQVVVNK | AAVMVHQLSK | (SEQ ID NO:1304) |
| ADBHUMAN | LHDINAQ_MVE_ | DQG--FLDSL | RDLIA----- | -DSNPMVVAN | AVAALSEISE | (SEQ ID NO:1305) |
| S60712c | SGMSQLI_GLK_ | EK---GLPQI | ARLLQ----- | -SGNSDVVRS | GASLLSNMSR | (SEQ ID NO:1306) |
| HSRNAUd | PTSVAQ_TVVQ_ | KES--GLQHT | RKMLH----- | -VGDPSVKKT | AISLLRNLSR | (SEQ ID NO:1307) |
| YEB3YEASTa | FAEITEK_YVR_ | QVSREVLEPI | LILLQ----- | -SQDPQIQVA | ACAALGNLAV | (SEQ ID NO:1308) |
| HSRNAUc | GADGRKAM_RR_ | CDG--LIDSL | VHYVR-(4)D | YQPDDKATEN | CVCILHNLSY | (SEQ ID NO:1309) |
| CTNBMOUSEb | KEASRHAI_MR_ | SPQ--MVSAI | VRTMQ----- | NTNDVETARC | TAGTLHNLSH | (SEQ ID NO:1310) |
| CET19B106 | ANQKHLEYVV | ELG--MLSAF | TDLLTCM--- | ---DVSLVSY | ILDAIYLLLQ | (SEQ ID NO:1311) |
| YSPPAA1B | AAG-GDS_TVY_ | EQQ--IIPLL | EQLTK----- | -DNDPDVQYF | ATQALEQTND | (SEQ ID NO:1312) |
| CRU40057a | NPQ-NIEA_LQ_ | QAG--AMALL | RPLLL----- | -DNVPSIQQS | AALALGRLAN | (SEQ ID NO:1313) |
| D87671 | YSDSLTA_AMI_ | DA---VLDEL | PPLISES--- | ---DMHVSQM | AISFLTTIAK | (SEQ ID NO:1314) |
| CELM01E114 | SQPDLYGSFV | EVN--GVEIL | LQLLG----- | -HENTDIVCA | TLSLLRELTD | (SEQ ID NO:1315) |
| HSZYGHOMO | ETPDNCEMFL | NFN--GMKLF | LDCLK----E | FPEKQELIRN | MLGLLGNVAE | (SEQ ID NO:1316) |
| YLK3CAEELa | CEEQAREQIR | IYD--GVPTL | LGLLS----- | -IKNSRLQWH | VAWTLAQLAE | (SEQ ID NO:1317) |
| GDS1HUMANb | DSHSLQAQ_LI_ | NMG--VIPTL | VKLLG----I | HCQNAALTEM | CLVAFGNLAE | (SEQ ID NO:1318) |
| COPBYEASTa | RQDANRT_PAL_ | KAQ--YIELL | MELLS----- | TTTSDEVIFE | TALALTVLSA | (SEQ ID NO:1319) |
| CEC48D1 | KSSKACT_NMI_ | QAG--IISIS | LSCMEK---- | -VESNDITTK | CLELLTNLSS | (SEQ ID NO:1320) |
| YEB3YEASTc | RDD-NKHK_IA_ | TSG--ALIPL | TKLAKSK--- | ---HIRVQRN | ATGALLNMTH | (SEQ ID NO:1321) |
| GDS1BOVINc | KSKDVIK_TIV_ | QSG--GIKHL | VTMATSE--- | ---HVIMQNE | ALVALALIAA | (SEQ ID NO:1322) |
| APCHUMANd | ADVNSKK_TLR_ | EVG--SVKAL | MECALEVKK- | -ESTLKSVLS | ALWNLSARNP | (SEQ ID NO:1323) |
| P115_BOVIN | SKK-YRLE_VG_ | IQ---AMEHL | LHVLQTD--- | -RSDSEIIGY | ALDTLYNIIS | (SEQ ID NO:1324) |
| YD71_SCHPO | PLE-MIQI_VT_ | KMN--IPDHL | TATLPRS--- | ---SDDIQND | CLFALRQVSK | (SEQ ID NO:1325) |
| CELB033611 | SDL-PAIQEQ | DMKE-SIHCI | VQLIG----- | -CSDVTIVEL | ATGTLRNIGL | (SEQ ID NO:1326) |
| Consensus/60% | ssp.pbphlb | pss..slshL | lpLLp..... | .p.s.plbp. | tshsLpNls. | |

TABLE 9-11

Abbreviations

| Group name | Amino acids | Displayed as |
|---|---|---|
| Default | X | . |
| Single | X | ▍ |
| Alanine | A | A |
| Cysteine | C | C |
| Aspartic Acid | D | D |
| Glutamic Acid | E | E |
| Phenylalanine | F | F |
| Glycine | G | G |
| Histidine | H | H |
| Isoleucine | I | I |
| Lysine | K | K |
| Leucine | L | L |
| Methionine | M | M |
| Asparagine | N | N |
| Proline | P | P |
| Glutamine | Q | Q |
| Arginine | R | R |
| Serine | S | S |
| Threonine | T | T |
| Valine | V | V |
| Tryptophan | W | W |
| Tyrosine | Y | Y |
| Negative | D,E | - |
| Ser/Thr | S,T | * |
| Aliphatic | I,L,V | l |
| Positive | H,K,R | + |
| Tiny | A,G,S | t |
| Aromatic | F,H,W,Y | a |
| Charged | D,E,H,K,R | c |
| Small | A,C,D,G,N,P,S,T,V | s |
| Polar | C,D,E,H,K,N,Q,R,S,T | p |
| Big | E,F,H,I,K,L,M,Q,R,W,Y | B |
| Hydrophobic | A,C,F,G,H,I,L,M,T,V,W,Y | h |

REFERENCES

Bondeson, D. P., Mares, A., Smith, I. E. D., Ko, E., Campos, S., Miah, A. H., Mulholland, K. E., Routly, N., Buckley, D. L., Gustafson, J. L., et al. (2015). Catalytic in vivo protein knockdown by small-molecule PROTACs. Nat. Chem. Biol. 11, 611-617.

Boudko, S. P., Londer, Y. Y., Letarov, A. V, Sernova, N. V, Engel, J., and Mesyanzhinov, V. V (2002). Domain organization, folding and stability of bacteriophage T4 fibritin, a segmented coiled-coil protein. Eur. J. Biochem. 269, 833-841.

Brunette, T. J., Parmeggiani, F., Huang, P.-S., Bhabha, G., Ekiert, D. C., Tsutakawa, S. E., Hura, G. L., Tainer, J. A., Baker, D. (2015) Exploring the repeat protein universe through computational protein design. Nature 528, 580-584.

Chapman & McNaughton, B. R. (2016). Scratching the surface: Resurfacing proteins to endow new properties and function. Cell Chem. Biol. 23, 543-553.

D'Andrea, L. D., and Regan, L. (2003). TPR proteins: the versatile helix. Trends Biochem. Sci. 28, 655-662.

Deshaies, R. J. (2015). Protein degradation: Prime time for PROTACs. Nat. Chem. Biol. 11, 634-635.

de Vries, S. J., and Bonvin, A. M. J. J. (2011). CPORT: a consensus interface predictor and its performance in prediction-driven docking with HADDOCK. PLoS One 6, e17695.

de Vries, S. J., van Dijk, M., and Bonvin, A. M. J. J. (2010). The HADDOCK web server for data-driven biomolecular docking. Nat. Protoc. 5, 883-897.

Guettler, S., LaRose, J., Petsalaki, E., Gish, G., Scotter, A., Pawson, T., Rottapel, R., and Sicheri, F. (2011). Structural basis and sequence rules for substrate recognition by Tankyrase explain the basis for cherubism disease. Cell 147, 1340-1354.

Güthe, S., Kapinos, L., Möglich, A., Meier, S., Grzesiek, S., and Kiefhaber, T. (2004). Very Fast Folding and Association of a Trimerization Domain from Bacteriophage T4 Fibritin. J. Mol. Biol. 337, 905-915.

Hao, B., Zheng, N., Schulman, B. A., Wu, G., Miller, J. J., Pagano, M., Pavletich, N. P. (2005). Structural basis of the Cks1-dependent recognition of p27(Kip1) by the SCF (Skp2) ubiquitin ligase. Mol. Cell 20, 9-19.

Kobe, B. & Kajava, A. V. (2000). When protein folding is simplified to protein coiling: the continuum of solenoid protein structures. Trends in Biochem. Sci. 25, 509-515.

Lee, J.-H., Kang, E., Lee, J., Kim, J., Lee, K. H., Han, J., Kang, H. Y., Ahn, S., Oh, Y., Shin, D., et al. (2014). Protein grafting of p53TAD onto a leucine zipper scaffold generates a potent HDM dual inhibitor. Nat. Commun. 5, 3814.

Leshchiner, E. S., Parkhitko, A., Bird, G. H., Luccarelli, J., Bellairs, J. A., Escudero, S., Opoku-Nsiah, K., Godes, M., Perrimon, N., and Walensky, L. D. (2015). Direct inhibition of oncogenic KRAS by hydrocarbon-stapled SOS1 helices. Proc. Natl. Acad. Sci. U.S.A 112, 1761-1766.

Longo, L. M. & Blaber, M. (2014). Symmetric protein architecture in protein design: to-down symmetric deconstruction. Methods Mol. Biol. 1216, 161-82.

Lu, J., Qian, Y., Altieri, M., Dong, H., Wang, J., Raina, K., Hines, J., Winkler, J. D., Crew, A. P., Coleman, K., et al. (2015). Hijacking the E3 Ubiquitin Ligase Cereblon to Efficiently Target BRD4. Chem. Biol. 22, 755-763.

Margarit, S. M., Sondermann, H., Hall, B. E., Nagar, B., Hoelz, A., Pirruccello, M., Bar-Sagi, D., and Kuriyan, J. (2003). Structural evidence for feedback activation by Ras.GTP of the Ras-specific nucleotide exchange factor SOS. Cell 112, 685-695.

Meier, S., Guthe, S., Kiefhaber, T. and Grzesiek, S. (2004). Foldon, the natural trimerization domain of T4 fibritin, dissociates into a monomeric A-state form containing a stable beta-hairpin: atomic details of timer dissociation and local beta-hairpin stability from residual dipolar couplings. J. Mol. Biol 344, 1051-1069.

Parmeggiani, F., Huang, P.-S., Vorobiev, S., Xiao, R., Park, K., Caprari, S., Su, M., Seetharaman, J., Mao, L., Janjua, H., Montelione, G. T., Hunt, J., Baker, D. (2015) A general computational approach for repeat protein design. J. Mol. Biol. 427, 563-575.

Rowling, P. J., Sivertssson, E. M., Perez-Riba, A., Main, E. R., Itzhaki, L. S. (2015) Biochem. Soc. Trans. 43 881-888.

Tamaskovic, R., Simon, Stefan, N., Scwhill, Pluckthun, A. (2012). Designed ankyrin repeat proteins (DARPins): From research to therapy. Methods in Enzym. 503, 101-134.

Thompson, D. B., Cronican, J. J., Liu, D. R. (2012). Engineering and identifying supercharged proteins for macromolecule delivery into mammalian cells. Methods Enzymol. 503, 293-319.

SEQUENCE LISTING (3101 sequences)

SEQ ID NO: 1 - protein, 34 aa, Artificial Sequence
  Description of Artificial Sequence: Synthetic TPR repeat domain
  MOD_RES (31)..(34): wherein X at positions 31-34 are independently any amino acid, preferably X31 and X32 being D and P respectively, or may be a variant of this sequence
AEAWYNLGNAYYKQGDYQKAIEYYQKALELXXXX

SEQ ID NO: 2 - protein, 34 aa, Artificial Sequence
  Description of Artificial Sequence: Synthetic TPR repeat domain
  MOD_RES (31)..(34): wherein X at position 31-34 are independently any amino acid, preferably X at 31 and 32 being D and P respectively
AEAWYNLGNAYYRQGDYQRAIEYYQRALELXXXX

SEQ ID NO: 3 - protein, 34 aa, Artificial Sequence
  Description of Artificial Sequence: Synthetic TPR repeat domain
  MOD_RES (31)..(34): wherein Xaa at position 31-34 are independently any amino acid, preferably X at 31 and 32 being D and P respectively
AEALNNLGNVYREQGDYQRAIEYYQRALELXXXX

SEQ ID NO: 4 - protein, 104 aa, Artificial Sequence
  Description of Artificial Sequence: Synthetic inter repeat loop sequence
  MOD_RES (3)..(102): This region is the binding domain and can be from 1 - 100 residues, where Xaa is independently any amino acid and may be the same amino acid or a different amino acid to any other residue
  MOD_RES (104)..(104): Xaa is independently any amino acid and may be the same amino acid or a different amino acid to any other residue
DPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPX

SEQ ID NO: 5 - protein, 108 aa, Artificial Sequence
  Description of Artificial Sequence: Synthetic inter repeat loop sequence
  MOD_RES (3)..(4): Xaa is independently any amino acid and may be the same amino acid or a different amino acid to any other residue
  MOD_RES (5)..(104): This region is the binding domain and can be from 1 - 100 residues, where Xaa is independently any amino acid and may be the same amino acid or a different amino acid to any other residue
  MOD_RES (105)..(106): Xaa is independently any amino acid and may be the same amino acid or a different amino acid to any other residue
  MOD_RES (108)..(108): Xaa is independently any amino acid and may be the same amino acid or a different amino acid to any other residue
DPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPX

SEQ ID NO: 6 - protein, 108 aa, Artificial Sequence
  Description of Artificial Sequence: Synthetic inter repeat loop sequence
  MOD_RES (3)..(4): Xaa is independently any amino acid and may be the same amino acid or a different amino acid to any other residue
  MOD_RES (5)..(104): This region is the binding domain and can be from 1 - 100 residues, where Xaa is independently any amino acid and may be the same amino acid or a different amino acid to any other residue
  MOD_RES (105)..(105): Xaa is independently any amino acid and may be the same amino acid or a different amino acid to any other residue
  MOD_RES (107)..(108): Xaa is independently any amino acid and may be the same amino acid or a different amino acid to any other residue
DPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXX

SEQ ID NO: 7 - protein, 108 aa, Artificial Sequence
  Description of Artificial Sequence: Synthetic inter repeat loop sequence
  MOD_RES (3)..(4): Xaa is independently any amino acid and may be the same amino acid or a different amino acid to any other residue
  MOD_RES (5)..(104): This region is the binding domain and can be from 1 - 100 residues, where Xaa is independently any amino acid and may be the same amino acid or a different amino acid to any other residue
  MOD_RES (106)..(108): Xaa is independently any amino acid and may be the same amino acid or a different amino acid to any other residue
DPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXX

SEQ ID NO: 8 - protein, 127 aa, Artificial Sequence
  Description of Artificial Sequence: Synthetic inter repeat loop sequence
  MOD_RES (2)..(3): Xaa is independently any amino acid and may be the same amino acid or a different amino acid to any other residue
  MOD_RES (4)..(13): This region is the linker and can be from 1 - 10 residues, where Xaa is independently any amino acid and may be the same amino acid or a different amino acid to any other residue
  MOD_RES (14)..(113): This region is the binding domain and can be from 1 - 100 residues, where Xaa is independently any amino acid and may be the same amino acid or a different amino acid to any other residue
  MOD_RES (114)..(123): This region is the linker and can be from 1 - 10 residues, where Xaa is independently any amino acid and may be the same amino acid or a different amino acid to any other residue
  MOD_RES (124)..(125): Xaa is independently any amino acid and may be the same amino acid or a different amino acid to any other residue
  MOD_RES (127)..(127): Xaa is independently any amino acid and may be the same amino acid or a different amino acid to any other residue
PXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPX

SEQ ID NO: 9 - protein, 128 aa, Artificial Sequence
  Description of Artificial Sequence: Synthetic inter repeat loop sequence
  MOD_RES (3)..(4): Xaa is independently any amino acid and may be the same amino acid or a different amino acid to any other residue
  MOD_RES (5)..(14): This region is the linker and can be from 1 - 10 residues, where Xaa is independently any amino acid and may be the same amino acid or a different amino acid to any other residue
  MOD_RES (15)..(114): This region is the binding domain and can be from 1 - 100 residues, where Xaa is independently any amino acid and may be the same amino acid or a different amino acid to any other residue
  MOD_RES (115)..(124): This region is the linker and can be from 1 - 10 residues, where Xaa is independently any amino acid and may be the same amino acid or a different amino acid to any other residue
  MOD_RES (125)..(125): Xaa is independently any amino acid and may be the same amino acid or a different amino acid to any other residue
  MOD_RES (127)..(128): Xaa is independently any amino acid and may be the same amino acid or a different amino acid to any other residue
DPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXX

SEQ ID NO: 10 - protein, 128 aa, Artificial Sequence
  Description of Artificial Sequence: Synthetic inter repeat loop sequence
  MOD_RES (3)..(4): Xaa is independently any amino acid and may be the same amino acid or a different amino acid to any other residue
  MOD_RES (5)..(14): This region is the linker and can be from 1 - 10 residues, where Xaa is independently any amino acid and may be the same amino acid or a different amino acid to any other residue
  MOD_RES (15)..(114): This region is the binding domain and can be from 1 - 100 residues, where Xaa is independently any amino acid and may be the same amino acid or a different amino acid to any other residue
  MOD_RES (115)..(124): This region is the linker and can be from 1 - 10 residues, where Xaa is independently any amino acid and may be the same amino acid or a different amino acid to any other residue
  MOD_RES (126)..(128): Xaa is independently any amino acid and may be the same amino acid or a different amino acid to any other residue
DPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXX

SEQ ID NO: 11 - protein, 118 aa, Artificial Sequence
  Description of Artificial Sequence: Synthetic inter repeat loop sequence
  MOD_RES (3)..(4): Xaa is independently any amino acid and may be the same amino acid or a different amino acid to any other residue
  MOD_RES (5)..(14): This region is the linker and can be from 1 - 10 residues, where Xaa is independently any amino acid and may be the same amino acid or a different amino acid to any other residue
  MOD_RES (15)..(114): This region is the binding domain and can be from 1 - 100 residues, where Xaa is independently any amino acid and may be the same amino acid or a different amino acid to any other residue
  MOD_RES (115)..(115): Xaa is independently any amino acid and may be the same amino acid or a different amino acid to any other residue
  MOD_RES (117)..(118): Xaa is independently any amino acid and may be the same amino acid or a different amino acid to any other residue
DPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXX

SEQ ID NO: 12 - protein, 118 aa, Artificial Sequence; identical to SEQ ID NO: 11
  Description of Artificial Sequence: Synthetic inter repeat loop sequence
  MOD_RES (3)..(4): Xaa is independently any amino acid and may be the same amino acid or a different amino acid to any other residue
  MOD_RES (5)..(14): This region is the linker and can be from 1 - 10 residues, where Xaa is independently any amino acid and may be the same amino acid or a different amino acid to any other residue
  MOD_RES (15)..(114): This region is the binding domain and can be from 1 - 100 residues, where Xaa is independently any amino acid and may be the same amino acid or a different amino acid to any other residue
  MOD_RES (115)..(115): Xaa is independently any amino acid and may be the same amino acid or a different amino acid to any other residue
  MOD_RES (117)..(118): Xaa is independently any amino acid and may be the same amino acid or a different amino acid to any other residue

SEQ ID NO: 13 - protein, 118 aa, Artificial Sequence; identical to SEQ ID NO: 11
  Description of Artificial Sequence: Synthetic inter repeat loop sequence
  MOD_RES (3)..(4): Xaa is independently any amino acid and may be the same amino acid or a different amino acid to any other residue
  MOD_RES (5)..(14): This region is the linker and can be from 1 - 10 residues, where Xaa is independently any amino acid and may be the same amino acid or a different amino acid to any other residue
  MOD_RES (15)..(114): This region is the binding domain and can be from 1 - 100 residues, where Xaa is independently any amino acid and may be the same amino acid or a different amino acid to any other residue
  MOD_RES (115)..(115): Xaa is independently any amino acid and may be the same amino acid or a different amino acid to any other residue
  MOD_RES (117)..(118): Xaa is independently any amino acid and may be the same amino acid or a different amino acid to any other residue

SEQ ID NO: 14 - protein, 118 aa, Artificial Sequence
  Description of Artificial Sequence: Synthetic inter repeat loop sequence
  MOD_RES (3)..(4): Xaa is independently any amino acid and may be the same amino acid or a different amino acid to any other residue
  MOD_RES (5)..(104): This region is the binding domain and can be from 1 - 100 residues, where Xaa is independently any amino acid and may be the same amino acid or a different amino acid to any other residue
  MOD_RES (105)..(114): This region is the linker and can be from 1 - 10 residues, where Xaa is independently any amino acid and may be the same amino acid or a different amino acid to any other residue
  MOD_RES (115)..(116): Xaa is independently any amino acid and may be the same amino acid or a different amino acid to any other residue
  MOD_RES (118)..(118): Xaa is independently any amino acid and may be the same amino acid or a different amino acid to any other residue
DPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPX

SEQ ID NO: 15 - protein, 118 aa, Artificial Sequence; identical to SEQ ID NO: 11
  Description of Artificial Sequence: Synthetic inter repeat loop sequence
  MOD_RES (3)..(4): Xaa is independently any amino acid and may be the same amino acid or a different amino acid to any other residue
  MOD_RES (5)..(104): This region is the binding domain and can be from 1 - 100 residues, where Xaa is independently any amino acid and may be the same amino acid or a different amino acid to any other residue
  MOD_RES (105)..(114): This region is the linker and can be from 1 - 10 residues, where Xaa is independently any amino acid and may be the same amino acid or a different amino acid to any other residue
  MOD_RES (115)..(115): Xaa is independently any amino acid and may be the same amino acid or a different amino acid to any other residue
  MOD_RES (117)..(118): Xaa is independently any amino acid and may be the same amino acid or a different amino acid to any other residue

SEQ ID NO: 16 - protein, 118 aa, Artificial Sequence
  Description of Artificial Sequence: Synthetic inter repeat loop sequence
  MOD_RES (3)..(4): Xaa is independently any amino acid and may be the same amino acid or a different amino acid to any other residue
  MOD_RES (5)..(104): This region is the binding domain and can be from 1 - 100 residues, where Xaa is independently any amino acid and may be the same amino acid or a different amino acid to any other residue
  MOD_RES (105)..(114): This region is the linker and can be from 1 - 10 residues, where Xaa is independently any amino acid and may be the same amino acid or a different amino acid to any other residue
  MOD_RES (116)..(118): Xaa is independently any amino acid and may be the same amino acid or a different amino acid to any other residue
DPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXX

SEQ ID NO: 17 - protein, 20 aa, Artificial Sequence
  Description of Artificial Sequence: Synthetic N terminal binding domain
  MOD_RES (1)..(1): Xaa is independently any amino acid and may be the same amino acid or a different amino acid to any other residue or not present
  MOD_RES (2)..(16): Xaa is independently any amino acid and may be the same amino acid or a different amino acid to any other residue
  MOD_RES (17)..(17): Xaa is independently any amino acid, preferably D
  MOD_RES (18)..(18): Xaa is independently any amino acid, preferably P
  MOD_RES (19)..(20): Xaa is independently any amino acid and may be the same amino acid or a different amino acid to any other residue
  See specification as filed for detailed description of substitutions and preferred embodiments
XXXXXXXXXXXXXXXXXXXX

SEQ ID NO: 18 - protein, 20 aa, Artificial Sequence
  Description of Artificial Sequence: Synthetic N terminal binding domain
  MOD_RES (1)..(1): Xaa is independently any amino acid and may be the same amino acid or a different amino acid to any other residue or not present
  MOD_RES (2)..(2): Xaa is independently any amino acid and may be the same amino acid or a different amino acid to any other residue
  MOD_RES (4)..(6): Xaa is independently any amino acid and may be the same amino acid or a different amino acid to any other residue
  MOD_RES (8)..(9): Xaa is independently any amino acid and may be the same amino acid or a different amino acid to any other residue
  MOD_RES (11)..(13): Xaa is independently any amino acid and may be the same amino acid or a different amino acid to any other residue
  MOD_RES (15)..(16): Xaa is independently any amino acid and may be the same amino acid or a different amino acid to any other residue
  MOD_RES (17)..(17): Xaa is independently any amino acid, preferably D
  MOD_RES (18)..(18): Xaa is independently any amino acid, preferably P
  MOD_RES (19)..(20): Xaa is independently any amino acid and may be the same amino acid or a different amino acid to any other residue
  See specification as filed for detailed description of substitutions and preferred embodiments
XXYXXXIXXYXXXLXXXXXX

SEQ ID NO: 19 - protein, 20 aa, Artificial Sequence
  Description of Artificial Sequence: Synthetic C terminal binding domain
  MOD_RES (1)..(1): Xaa is independently any amino acid, preferably D
  MOD_RES (2)..(2): Xaa is independently any amino acid, preferably P
  MOD_RES (3)..(6): Xaa is independently any amino acid and may be the same amino acid or a different amino acid to any other residue
  MOD_RES (8)..(10): Xaa is independently any amino acid and may be the same amino acid or a different amino acid to any other residue
  MOD_RES (12)..(13): Xaa is independently any amino acid and may be the same amino acid or a different amino acid to any other residue
  MOD_RES (14)..(14): Xaa is A or V
  MOD_RES (15)..(19): Xaa is independently any amino acid and may be the same amino acid or a different amino acid to any other residue
  MOD_RES (20)..(20): Any amino acid or not present
  See specification as filed for detailed description of substitutions and preferred embodiments
XXXXXXAXXXLXXXXXXXXX

SEQ ID NO: 20 - protein, 19 aa, Artificial Sequence
  Description of Artificial Sequence: Synthetic Beta-catenin-binding domains derived from axin
GAYPEYILDIHVYRVQLEL

SEQ ID NO: 21 - protein, 22 aa, Artificial Sequence
  Description of Artificial Sequence: Synthetic Beta-catenin-binding domains derived from Bcl-9
SQEQLEHRYRSLITLYDIQLML

SEQ ID NO: 22 - protein, 19 aa, Artificial Sequence
  Description of Artificial Sequence: Synthetic Beta-catenin-binding domains derived from TCF7L2
QELGDNDELMHFSYESTQD

SEQ ID NO: 23 - protein, 16 aa, Artificial Sequence
  Description of Artificial Sequence: Synthetic Beta-catenin-binding domains derived from ICAT
YAYQRAIVEYMLRLMS

SEQ ID NO: 24 - protein, 14 aa, Artificial Sequence
  Description of Artificial Sequence: Synthetic Beta-catenin-binding domains derived from LRH-1
YEQAIAAYLDALMC

SEQ ID NO: 25 - protein, 16 aa, Artificial Sequence
  Description of Artificial Sequence: Synthetic Beta-catenin-binding domains derived from APC
SCSEELEALEALELDE

SEQ ID NO: 26 - protein, 15 aa, Artificial Sequence
  Description of Artificial Sequence: Synthetic KRAS-binding domain from SOS-1
FEGIALTNYLKALEG

SEQ ID NO: 27 - protein, 8 aa, Artificial Sequence
  Description of Artificial Sequence: Synthetic tankyrase binding domains from Axin
REAGDGEE

SEQ ID NO: 28 - protein, 14 aa, Artificial Sequence
  Description of Artificial Sequence: Synthetic tankyrase binding domains from Axin
HLQREAGDGEEFRS

SEQ ID NO: 29 - protein, 12 aa, Artificial Sequence
  Description of Artificial Sequence: Synthetic ESAP1 peptide
TMRGKKKRTRAN

SEQ ID NO: 30 - protein, 15 aa, Artificial Sequence
  Description of Artificial Sequence: Synthetic Aurora-A binding sequences from TPX2
SYSYDAPSDFINFSS

SEQ ID NO: 31 - protein, 19 aa, Artificial Sequence
  Description of Artificial Sequence: Synthetic WDR5-interacting motif (WIN) of MLL1
EPPLNPHGSARAEVHLRKS

SEQ ID NO: 32 - protein, 20 aa, Artificial Sequence
  Description of Artificial Sequence: Synthetic binding sequences from the N-terminus of MAML1 (mastermind like protein 1)
SAVMERLRRRIELCRRHHST

SEQ ID NO: 33 - protein, 22 aa, Artificial Sequence
  Description of Artificial Sequence: Synthetic Cdk2 sequences derived from cyclin A
TYTKKQVLRMEHLVLKVLTFDL

SEQ ID NO: 34 - protein, 15 aa, Artificial Sequence
  Description of Artificial Sequence: Synthetic sequences that bind to the substrate-binding PBD (polo-box domain)
MAGPMQSEPLMGAKK

SEQ ID NO: 35 - protein, 12 aa, Artificial Sequence
  Description of Artificial Sequence: Synthetic tau-binding sequences derived from alpha- and beta-tubulin
KDYEEVGVDSVE

SEQ ID NO: 36 - protein, 13 aa, Artificial Sequence
  Description of Artificial Sequence: Synthetic tau-binding sequences derived from alpha- and beta-tubulin
YQQYQDATADEQG

SEQ ID NO: 37 - protein, 12 aa, Artificial Sequence
  Description of Artificial Sequence: Synthetic optimized substrate-derived sequence
EAIYAAPFAKKK

SEQ ID NO: 38 - protein, 8 aa, Artificial Sequence
  Description of Artificial Sequence: Synthetic sequence that bind the B56 regulatory subunit
LQTIQEEE

SEQ ID NO: 39 - protein, 27 aa, Artificial Sequence
  Description of Artificial Sequence: Synthetic helical binding sequences from co-factor EZH2
FSSNRQKILERTEILNQEWKQRRIQPV

SEQ ID NO: 40 - protein, 21 aa, Artificial Sequence
  Description of Artificial Sequence: Synthetic sequence from BCL2
KALETLRRVGDGVQRNHETAF

SEQ ID NO: 41 - protein, 19 aa, Artificial Sequence
  Description of Artificial Sequence: Synthetic RAS-binding peptides identified by phage display
RRRRCPLYISYDPVCRRRR

SEQ ID NO: 42 - protein, 11 aa, Artificial Sequence
  Description of Artificial Sequence: Synthetic substrate-competitive binding sequence
KEAPPAPPQDP

SEQ ID NO: 43 - protein, 11 aa, Artificial Sequence
  Description of Artificial Sequence: Synthetic competitive binding sequence
KEAPPAPPQDP

SEQ ID NO: 44 - protein, 14 aa, Artificial Sequence
  Description of Artificial Sequence: Synthetic competitive binding sequence
RREGGMSRPADVDG

SEQ ID NO: 45 - protein, 26 aa, Artificial Sequence
  Description of Artificial Sequence: Synthetic competitive binding sequence
YRRAAVPPSPSLSRHSSPSQDEDEEE

SEQ ID NO: 46 - protein, 9 aa, Artificial Sequence
  Description of Artificial Sequence: Synthetic CtBP binding domain
SGWTVVRMY

SEQ ID NO: 47 - protein, 12 aa, Artificial Sequence
  Description of Artificial Sequence: Synthetic binding domain from p53
FAAYWNLLSAYG

SEQ ID NO: 48 - protein, 12 aa, Artificial Sequence
  Description of Artificial Sequence: Synthetic binding domain from p27
AGSNEQEPKKRS

SEQ ID NO: 49 - protein, 7 aa, Artificial Sequence
  Description of Artificial Sequence: Synthetic binding domain from Nrf2
DPETGEL

SEQ ID NO: 50 - protein, 15 aa, Artificial Sequence
  Description of Artificial Sequence: Synthetic binding domain from Puc
LACDEVTSTTSSSTA

SEQ ID NO: 51 - protein, 16 aa, Artificial Sequence
  Description of Artificial Sequence: Synthetic degron ABBA
SLSSAFHVFEDGNKEN

SEQ ID NO: 52 - protein, 9 aa, Artificial Sequence
  Description of Artificial Sequence: Synthetic Degron KEN
SEDKENVPP

SEQ ID NO: 53 - protein, 11 aa, Artificial Sequence
  Description of Artificial Sequence: Synthetic Degron DBOX
PRLPLGDVSNN

SEQ ID NO: 54 - protein, 11 aa, Artificial Sequence
  Description of Artificial Sequence: Synthetic binding domain from PHYL
LRPVAMVRPTV

SEQ ID NO: 55 - protein, 8 aa, Artificial Sequence
  Description of Artificial Sequence: Synthetic binding domain for CHIP
ASRMEEVD

SEQ ID NO: 56 - protein, 8 aa, Artificial Sequence
  Description of Artificial Sequence: Synthetic binding domain for CHIP
GPTIEEVD

SEQ ID NO: 57 - protein, 6 aa, Artificial Sequence
  Description of Artificial Sequence: Synthetic binding domain for beta-TrCP
DDGYFD

SEQ ID NO: 58 - protein, 16 aa, Artificial Sequence
  Description of Artificial Sequence: Synthetic binding domain for Fbx4
MPIFWKAHRMSKMGTG

SEQ ID NO: 59 - protein, 11 aa, Artificial Sequence
  Description of Artificial Sequence: Synthetic binding domain for FBw7
LPSGLLEPPQD

SEQ ID NO: 60 - protein, 13 aa, Artificial Sequence
  Description of Artificial Sequence: Synthetic binding domain for DDB1-Cul4
ILPKVLHKRTLGL

SEQ ID NO: 61 - protein, 13 aa, Artificial Sequence
  Description of Artificial Sequence: Synthetic binding domain for DDB1-Cul4
NFVSWHANRQLGM

SEQ ID NO: 62 - protein, 13 aa, Artificial Sequence
  Description of Artificial Sequence: Synthetic binding domain for DDB1-Cul4
NTVEYFTSQQVTG

SEQ ID NO: 63 - protein, 13 aa, Artificial Sequence
  Description of Artificial Sequence: Synthetic binding domain for DDB1-Cul4
NITRDLIRRQIKE

SEQ ID NO: 64 - protein, 5 aa, Artificial Sequence
  Description of Artificial Sequence: Synthetic binding domain
KFERQ

SEQ ID NO: 65 - DNA, 57 bp, Artificial Sequence
  Description of Artificial Sequence: Synthetic axin derived E coli binding sequence
ggtgcatatccggaatacatcctggatattcatgtttatcgtgttcagctggaactg

SEQ ID NO: 66 - DNA, 57 bp, Artificial Sequence
  Description of Artificial Sequence: Synthetic axin derived human binding sequence
ggcgcctaccccgagtacatcctggacatccacgtgtaccgggtgcagctggaactg

SEQ ID NO: 67 - DNA, 66 bp, Artificial Sequence
  Description of Artificial Sequence: Synthetic Bcl-9 derived E. coli binding sequence
agccaagaacagctggaacatcgttatcgtagcctgattaccctgtatgatattcagctgatgctg

SEQ ID NO: 68 - DNA, 66 bp, Artificial Sequence
  Description of Artificial Sequence: Synthetic Bcl-9 derived human binding sequence
agccaggaacagctggaacaccggtacagaagcctgatcaccctgtacgacatccagctgatgctg

SEQ ID NO: 69 - DNA, 57 bp, Artificial Sequence
  Description of Artificial Sequence: Synthetic TCF-4 derived E. coli binding sequence
caagaactgggcgataatgatgaactgatgcactttagctatgaaagcacccaggat

SEQ ID NO: 70 - DNA, 57 bp, Artificial Sequence
  Description of Artificial Sequence: Synthetic TCF-4 derived Human binding sequence
caggaactgggcgataacgacgagctgatgcacttcagctacgagagcacccaggac

SEQ ID NO: 71 - DNA, 48 bp, Artificial Sequence
  Description of Artificial Sequence: Synthetic ICAT derived E. coli binding sequence
tatgcatatcagcgtgccatcgttgaatatatgctgcgtctgatgagc

SEQ ID NO: 72 - DNA, 48 bp, Artificial Sequence
  Description of Artificial Sequence: Synthetic ICAT derived human binding sequence
tacgcctaccagcgggccatcgtggagtacatgctgcggctgatgagc

SEQ ID NO: 73 - DNA, 42 bp, Artificial Sequence
  Description of Artificial Sequence: Synthetic LRH-1 derived E. coli binding sequence
tatgaacaggcaattgcagcatatctggatgcactgatgtgt

SEQ ID NO: 74 - DNA, 42 bp, Artificial Sequence
  Description of Artificial Sequence: Synthetic LRH-1 derived human binding sequence
tacgagcaggccattgccgcctacctggacgccctgatgtgc

SEQ ID NO: 75 - DNA, 48 bp, Artificial Sequence
  Description of Artificial Sequence: Synthetic APC derived E. coli binding sequence
agctgtagcgaagaactggaagccctggaagcattagaactggatgaa

SEQ ID NO: 76 - DNA, 48 bp, Artificial Sequence
  Description of Artificial Sequence: Synthetic APC derived human binding sequence
agctgtagcgaggaactggaagctctggaagcactggaactggatgag

SEQ ID NO: 77 - DNA, 45 bp, Artificial Sequence
  Description of Artificial Sequence: Synthetic SOS-1 derived E. coli binding sequence
tttgaaggtattgcactgaccaattatctgaaagcactggaaggt

SEQ ID NO: 78 - DNA, 45 bp, Artificial Sequence
  Description of Artificial Sequence: Synthetic SOS-1 derived human binding sequence
ttcgagggaatcgccctgaccaactacctgaaggccctggaagga

SEQ ID NO: 79 - DNA, 24 bp, Artificial Sequence
  Description of Artificial Sequence: Synthetic Axin (8-residue) derived E. coli binding sequence
cgtgaagccggtgatggtgaagaa

SEQ ID NO: 80 - DNA, 24 bp, Artificial Sequence
  Description of Artificial Sequence: Synthetic Axin (8 residue) derived human binding sequence
agagaagctggcgacggcgaagaa

SEQ ID NO: 81 - DNA, 42 bp, Artificial Sequence
  Description of Artificial Sequence: Synthetic Axin (14 residue) derived E. coli binding sequence
catctgcagcgtgaagccggtgatggtgaagaatttcgtagc

SEQ ID NO: 82 - DNA, 42 bp, Artificial Sequence; identical to SEQ ID NO: 81
  Description of Artificial Sequence: Synthetic Axin (14 residue) derived human binding sequence

SEQ ID NO: 83 - DNA, 36 bp, Artificial Sequence
  Description of Artificial Sequence: Synthetic p53 E. coli degron
tttgcagcctattggaatctgctgagcgcatatggt

SEQ ID NO: 84 - DNA, 36 bp, Artificial Sequence
  Description of Artificial Sequence: Synthetic p53 human degron
ttcgccgcctactggaacctgctgagcgcctacggt

SEQ ID NO: 85 - protein, 9 aa, Artificial Sequence
  Description of Artificial Sequence: Synthetic p53 amino acid degron
RFMDYWEGL

SEQ ID NO: 86 - DNA, 27 bp, Artificial Sequence
  Description of Artificial Sequence: Synthetic p53 E. coli degon
cgcttcatggattattgggaaggtctg

SEQ ID NO: 87 - DNA, 27 bp, Artificial Sequence
  Description of Artificial Sequence: Synthetic p53 human degron
cggttcatggattactgggagggcctg

SEQ ID NO: 88 - protein, 14 aa, Artificial Sequence
  Description of Artificial Sequence: Synthetic p53 amino acid degron
TSFAEYWALLAENL

SEQ ID NO: 89 - DNA, 42 bp, Artificial Sequence
  Description of Artificial Sequence: Synthetic p53 E. coli degron
accagctttgccgagtattgggccctgctggccgagaatctg

SEQ ID NO: 90 - DNA, 42 bp, Artificial Sequence; identical to SEQ ID NO: 89
  Description of Artificial Sequence: Synthetic p53 human degron

SEQ ID NO: 91 - DNA, 36 bp, Artificial Sequence
  Description of Artificial Sequence: Synthetic p27 E. coli degron
gcaggtagcaatgaacaagaaccgaaaaaacgtagt

SEQ ID NO: 92 - DNA, 36 bp, Artificial Sequence
  Description of Artificial Sequence: Synthetic p27 human degron
gccggctctaatgagcaagagcccaagaagagaagc

SEQ ID NO: 93 - DNA, 21 bp, Artificial Sequence
  Description of Artificial Sequence: Synthetic Nrf2 E. coli degron
gatccggaaaccggtgaactg

SEQ ID NO: 94 - DNA, 21 bp, Artificial Sequence
  Description of Artificial Sequence: Synthetic Nrf2 human degron
gatcctgaaacaggcgaactg

SEQ ID NO: 95 - DNA, 45 bp, Artificial Sequence
  Description of Artificial Sequence: Synthetic SBC E. coli degron
ctggcatgtgatgaagttaccagcaccaccagtagcagcaccgca

SEQ ID NO: 96 - DNA, 45 bp, Artificial Sequence
  Description of Artificial Sequence: Synthetic SBC human degron
ctggcctgtgatgaagtgaccagcaccaccagcagctccacagcc

SEQ ID NO: 97 - DNA, 48 bp, Artificial Sequence
  Description of Artificial Sequence: Synthetic ABBA E. coli degron
agcctgagcagcgcatttcatgtttttgaagatggcaacaaagaaaat

SEQ ID NO: 98 - DNA, 48 bp, Artificial Sequence
  Description of Artificial Sequence: Synthetic ABBA human degron
tctctgtctagcgccttccacgtgttcgaggacggcaacaaagagaac

SEQ ID NO: 99 - protein, 4 aa, Artificial Sequence
  Description of Artificial Sequence: Synthetic ABOX amino acid degron
QRVL

SEQ ID NO: 100 - DNA, 12 bp, Artificial Sequence
  Description of Artificial Sequence: Synthetic ABOX human degron
cagcgtgttctg

SEQ ID NO: 101 - DNA, 12 bp, Artificial Sequence
  Description of Artificial Sequence: Synthetic ABOX human degron
cagagagttctg

SEQ ID NO: 102 - DNA, 27 bp, Artificial Sequence
  Description of Artificial Sequence: Synthetic KEN E. coli degron
agcgaggataaagaaaatgttccgcct

SEQ ID NO: 103 - DNA, 27 bp, Artificial Sequence
  Description of Artificial Sequence: Synthetic KEN human degron
agcgaggacaaagaaaacgtgccacct

SEQ ID NO: 104 - DNA, 33 bp, Artificial Sequence
  Description of Artificial Sequence: Synthetic DBOX E. coli degron
ccgcgtctgccgctgggtgatgttagcaataat

SEQ ID NO: 105 - DNA, 33 bp, Artificial Sequence
  Description of Artificial Sequence: Synthetic DBOX human degron
cctagactgcctctgggagatgtgtccaacaac

SEQ ID NO: 106 - DNA, 33 bp, Artificial Sequence
  Description of Artificial Sequence: Synthetic PHYL E. coli degron
ctgcgtccggttgcaatggttcgtccgaccgtt

SEQ ID NO: 107 - DNA, 33 bp, Artificial Sequence
  Description of Artificial Sequence: Synthetic PHYL human degron
ctgaggcctgtggctatggtgcgccctacagtg

SEQ ID NO: 108 - protein, 12 aa, Artificial Sequence
  Description of Artificial Sequence: Synthetic cyclin-D3 amino acid degron
PEQTSEPTDVAI

SEQ ID NO: 109 - DNA, 36 bp, Artificial Sequence
  Description of Artificial Sequence: Synthetic cyclin-D3 E coli degron
ccggaacagaccagcgaaccgaccgatgttgcaatt

SEQ ID NO: 110 - DNA, 36 bp, Artificial Sequence
  Description of Artificial Sequence: Synthetic cyclin-D3 human degron
cctgagcagacaagcgagcctacagatgtggccatc

SEQ ID NO: 111 - protein, 6 aa, Artificial Sequence
  Description of Artificial Sequence: Synthetic myc amino acid degron
EPPLEP

SEQ ID NO: 112 - DNA, 18 bp, Artificial Sequence
  Description of Artificial Sequence: Synthetic myc E. coli degron
gaaccgcctctggaaccg

SEQ ID NO: 113 - DNA, 18 bp, Artificial Sequence
  Description of Artificial Sequence: Synthetic myc human degron
gagcctcctcttgaacct

SEQ ID NO: 114 - protein, 8 aa, Artificial Sequence
  Description of Artificial Sequence: Synthetic cyclin E1 amino acid degron
SLIPEPDR

SEQ ID NO: 115 - DNA, 24 bp, Artificial Sequence
  Description of Artificial Sequence: Synthetic cyclin E1 E. coli degron
agcctgattccggaaccggatcgt

SEQ ID NO: 116 - DNA, 24 bp, Artificial Sequence
  Description of Artificial Sequence: Synthetic cyclin E1 human degron
tctctgatccccgagcctgacaga

SEQ ID NO: 117 - protein, 12 aa, Artificial Sequence
  Description of Artificial Sequence: Synthetic PIP amino acid degron
QRRMTDFYARRR

SEQ ID NO: 118 - DNA, 36 bp, Artificial Sequence
  Description of Artificial Sequence: Synthetic PIP E. coli degron
cagcgtcgtatgaccgatttttatgcacgtcgtcgt

SEQ ID NO: 119 - DNA, 36 bp, Artificial Sequence
  Description of Artificial Sequence: Synthetic PIP human degron
cagagaaggatgaccgacttctacgccagaaggcgg

SEQ ID NO: 120 - protein, 12 aa, Artificial Sequence
  Description of Artificial Sequence: Synthetic paramoxyviru s SV5-V protein amino acid degron
TVAYFTLQQVYG

SEQ ID NO: 121 - DNA, 36 bp, Artificial Sequence
  Description of Artificial Sequence: Synthetic paramoxyviru s SV5-V protein E. coli degron
accgttgcatattttaccctgcagcaggtttatggt

SEQ ID NO: 122 - DNA, 36 bp, Artificial Sequence
  Description of Artificial Sequence: Synthetic paramoxyviru s SV5-V protein human degron
accgtggcctacttcacactgcagcaggtttacggc

SEQ ID NO: 123 - protein, 13 aa, Artificial Sequence
  Description of Artificial Sequence: Synthetic Hepatitis B virus X protein amino acid degron
ILPAVLHLRTVYG

SEQ ID NO: 124 - DNA, 39 bp, Artificial Sequence
  Description of Artificial Sequence: Synthetic Hepatitis B virus X proteain E. coli degron
attctgcctgcagttctgcatctgcgtaccgtttatggt

SEQ ID NO: 125 - DNA, 39 bp, Artificial Sequence
  Description of Artificial Sequence: Synthetic Hepatitis B virus X protein human degron
attctgcctgccgtgctgcacctgagaacagtgtatgga

SEQ ID NO: 126 - protein, 13 aa, Artificial Sequence
  Description of Artificial Sequence: Synthetic Woodchuck Hepatitis virus X protein amino acid degron
NFVAWHALRQVYG

SEQ ID NO: 127 - DNA, 39 bp, Artificial Sequence
  Description of Artificial Sequence: Synthetic Woodchuck Hepatitis virus x protein E. coli degron
aattttgttgcatggcatgcactgcgtcaggtttatggt

SEQ ID NO: 128 - DNA, 39 bp, Artificial Sequence; identical to SEQ ID NO: 127
  Description of Artificial Sequence: Synthetic Woodchuck hepatitis virus x protein human degron

SEQ ID NO: 129 - protein, 13 aa, Artificial Sequence
  Description of Artificial Sequence: Synthetic DCAF9 amino acid degron
NITADLILRQVYG

SEQ ID NO: 130 - DNA, 39 bp, Artificial Sequence
  Description of Artificial Sequence: Synthetic DCAF9 E. coli degron
aacattaccgcagatctgattctgcgtcaggtttatggt

SEQ ID NO: 131 - DNA, 39 bp, Artificial Sequence
  Description of Artificial Sequence: Synthetic DCAF9 human degron
aacatcaccgccgacctgatcctgagacaggtgtacgga

SEQ ID NO: 132 - protein, 4 aa, Artificial Sequence
  Description of Artificial Sequence: Synthetic Bonger amino acid degron
RRRG

SEQ ID NO: 133 - DNA, 12 bp, Artificial Sequence
  Description of Artificial Sequence: Synthetic Bonger E. coli degron
cgtcgtcgtggt

SEQ ID NO: 134 - DNA, 12 bp, Artificial Sequence
  Description of Artificial Sequence: Synthetic Bonger human degron
agaagaagaggc

SEQ ID NO: 135 - protein, 4 aa, Artificial Sequence
  Description of Artificial Sequence: Synthetic iNOS amino acid degron
DINN

SEQ ID NO: 136 - DNA, 12 bp, Artificial Sequence
  Description of Artificial Sequence: Synthetic iNOS E. coli degron
gacatcaacaac

SEQ ID NO: 137 - DNA, 12 bp, Artificial Sequence
  Description of Artificial Sequence: Synthetic iNOS human degron
gacatcaacaac

SEQ ID NO: 138 - protein, 6 aa, Artificial Sequence
  Description of Artificial Sequence: Synthetic Beta-catenin amino acid degron
DEGNYE

SEQ ID NO: 139 - DNA, 18 bp, Artificial Sequence
  Description of Artificial Sequence: Synthetic Beta-catenin E. coli degron
gatgaaggcaactatgaa

SEQ ID NO: 140 - DNA, 18 bp, Artificial Sequence
  Description of Artificial Sequence: Synthetic Beta-catenin human degron
gacgagggcaattacgag

SEQ ID NO: 141 - protein, 15 aa, Artificial Sequence
  Description of Artificial Sequence: Synthetic cyclin D1 amino acid degron
EEEVSLASEPTDVRD

SEQ ID NO: 142 - DNA, 45 bp, Artificial Sequence
  Description of Artificial Sequence: Synthetic cycin D1 E. coli degron
gaagaagaagttagcctggcaagcgaaccgaccgatgttcgtgat

SEQ ID NO: 143 - DNA, 45 bp, Artificial Sequence
  Description of Artificial Sequence: Synthetic cycin D1 human degron
gaggaagaagtgtctctggccagcgagcctaccgatgttcgagat

SEQ ID NO: 144 - DNA, 24 bp, Artificial Sequence
  Description of Artificial Sequence: Synthetic hsp90 E. coli degron
gcaagccgtatggaagaagttgat

SEQ ID NO: 145 - DNA, 24 bp, Artificial Sequence
  Description of Artificial Sequence: Synthetic Hsp90 human degron
gccagcagaatggaagaggtggac

SEQ ID NO: 146 - DNA, 24 bp, Artificial Sequence
  Description of Artificial Sequence: Synthetic Hsp70 E. coli degron
ggtccgaccattgaagaagttgat

SEQ ID NO: 147 - DNA, 24 bp, Artificial Sequence
  Description of Artificial Sequence: Synthetic Hsp70 human degron
ggccctacaatcgaggaagtggac

SEQ ID NO: 148 - DNA, 102 bp, Artificial Sequence
  Description of Artificial Sequence: Synthetic RTPRc alignment sequence
  modified_base (97)..(102): n is a, c, g, or t
gcagaagcactgcgtaatctgggtcgtgtttatcgtcgtcagggtcgttatcagcgtgcaattgaatattatcgtcgcgcactggaattagatccgnnnnnn

SEQ ID NO: 149 - DNA, 102 bp, Artificial Sequence
  Description of Artificial Sequence: Synthetic RTPRa-ii-H alignment sequence
  modified_base (97)..(102): n is a, c, g, or t
gccgaagcttggtataatctggggaatgcctattacagacagggggattatcagcgcgccattgaatattatcagcgggctctggaactggatcctnnnnnn

SEQ ID NO: 150 - DNA, 102 bp, Artificial Sequence
  Description of Artificial Sequence: Synthetic RTPRa-i-E alignment sequence
  modified_base (97)..(102): n is a, c, g, or t
gcagaagcatggtataatctgggtaatgcatattatcgccagggtgattatcagcgtgccattgaatattatcaacgtgcactggaactggacccgnnnnnn

SEQ ID NO: 151 - DNA, 102 bp, Artificial Sequence
  Description of Artificial Sequence: Synthetic RTPRa-iii-E alignment sequence
  modified_base (97)..(102): n is a, c, g, or t
gcagaagcatggtataatctgggcaatgcatattatcgtcagggtgattatcagcgtgccatcgaatattatcaacgtgcactggaactggacccgnnnnnn

SEQ ID NO: 152 - DNA, 102 bp, Artificial Sequence
  Description of Artificial Sequence: Synthetic CTPRa-E alignment sequence
  modified_base (97)..(102): n is a, c, g, or t
gcagaagcatggtataatctgggtaatgcatattacaaacagggcgattatcagaaagccatcgagtattatcaaaaagcactggaactggacccgnnnnnn

SEQ ID NO: 153 - DNA, 102 bp, Artificial Sequence
  Description of Artificial Sequence: Synthetic CTPRb-E alignment sequence
  modified_base (97)..(102): n is a, c, g, or t
gcagaagcactgaataatctgggtaatgtttatcgtgaacagggcgattatcagaaagccatcgaatattatcaaaaagcgctggaactggacccgnnnnnn

SEQ ID NO: 154 - DNA, 102 bp, Artificial Sequence
  Description of Artificial Sequence: Synthetic RTPRb-E alignment sequence
  modified_base (97)..(102): n is a, c, g, or t
gcagaagcactgaataatctgggtaatgtttatcgtgaacagggcgattatcagcgtgccattgaatattatcaacgtgcgctggaattagatccgnnnnnn

SEQ ID NO: 155 - DNA, 102 bp, Artificial Sequence
  Description of Artificial Sequence: Synthetic RTPRa-ii-E alignment sequence
  modified_base (97)..(102): n is a, c, g, or t
gccgaggcctggtataaccttggcaacgcctattatcgtcaaggcgactaccagagagcaatcgaatattaccagcgtgcgttagaattagatccgnnnnnn

SEQ ID NO: 156 - DNA, 102 bp, Artificial Sequence
  Description of Artificial Sequence: Synthetic RTPRc-H alignment sequence
  modified_base (97)..(102): n is a, c, g, or t
gccgaggctctgagaaatctgggcagagtgtacagacggcagggcagataccagcgggccatcgagtattaccgcagagccctggaactggaccccnnnnnn

SEQ ID NO: 157 - DNA, 102 bp, Artificial Sequence
  Description of Artificial Sequence: Synthetic CTPRb-H alignment sequence
  modified_base (97)..(102): n is a, c, g, or t
gccgaggctctgaacaacctgggcaacgtgtacagagagcagggcgactaccagaaggccatcgagtattatcagaaggccctggaactggaccccnnnnnn

SEQ ID NO: 158 - DNA, 102 bp, Artificial Sequence
  Description of Artificial Sequence: Synthetic RTPRb-H alignment sequence
  modified_base (97)..(102): n is a, c, g, or t
gccgaggctctgaacaacctgggcaacgtgtacagagagcagggcgactaccagcgggccatcgagtattatcagagagccctggaactggaccccnnnnnn

SEQ ID NO: 159 - DNA, 102 bp, Artificial Sequence
  Description of Artificial Sequence: Synthetic RTPRa-iv-E alignment sequence
  modified_base (97)..(102): n is a, c, g, or t
gccgaggcctggtacaacctgggtaacgcctattatcgccaaggcgactaccagcgtgcaattgagtactaccaacgtgccctggaactggaccctnnnnnn

SEQ ID NO: 160 - DNA, 102 bp, Artificial Sequence
  Description of Artificial Sequence: Synthetic CTPRa-H alignment sequence
  modified_base (97)..(102): n is a, c, g, or t
gccgaggcctggtacaatctgggcaacgcctactacaagcagggcgactaccagaaggccatcgagtattatcagaaggccctggaactggaccccnnnnnn

SEQ ID NO: 161 - DNA, 102 bp, Artificial Sequence
  Description of Artificial Sequence: Synthetic RTPRa-i-H alignment sequence
  modified_base (97)..(102): n is a, c, g, or t
gccgaggcctggtacaacctgggcaacgcctactaccggcagggcgactaccagcgggccatcgagtactaccagagagccctggaactggaccctnnnnnn

SEQ ID NO: 162 - protein, 30 aa, Artificial Sequence
  Description of Artificial Sequence: Synthetic Human blood repeat domain
AEAYSNLGNVYKERGQLQEAIEHYRHALRL

SEQ ID NO: 163 - protein, 30 aa, Artificial Sequence
  Description of Artificial Sequence: Synthetic Human blood repeat domain
AVAWSNLGCVFNAQGEIWLAIHHFEKAVTL

SEQ ID NO: 164 - protein, 30 aa, Artificial Sequence
  Description of Artificial Sequence: Synthetic Human blood repeat domain
ADSLNNLANIKREQGNIEEAVRLYRKALEV

SEQ ID NO: 165 - protein, 25 aa, Artificial Sequence
  Description of Artificial Sequence: Synthetic Human blood repeat domain
NLACVYYEQGLIDLAIDTYRRAIEL

SEQ ID NO: 166 - protein, 30 aa, Artificial Sequence; identical to SEQ ID NO: 162
  Description of Artificial Sequence: Synthetic Human blood repeat domain

SEQ ID NO: 167 - protein, 30 aa, Artificial Sequence; identical to SEQ ID NO: 163
  Description of Artificial Sequence: Synthetic Human blood repeat domain

SEQ ID NO: 168 - protein, 30 aa, Artificial Sequence; identical to SEQ ID NO: 164
  Description of Artificial Sequence: Synthetic Human blood repeat domain

SEQ ID NO: 169 - protein, 25 aa, Artificial Sequence
  Description of Artificial Sequence: Synthetic Human blood repeat domain
NLACVYYEQGLIDLAIDTYRRAIEL

SEQ ID NO: 170 - protein, 30 aa, Artificial Sequence; identical to SEQ ID NO: 162
  Description of Artificial Sequence: Synthetic Human blood repeat domain

SEQ ID NO: 171 - protein, 29 aa, Artificial Sequence
  Description of Artificial Sequence: Synthetic Human blood repeat domain
ESFYNLGRGLHQLGLIHLAIHYYQKALEL

SEQ ID NO: 172 - protein, 28 aa, Artificial Sequence
  Description of Artificial Sequence: Synthetic Human blood repeat domain
AWYGLGMIYYKQEKFSLAEMHFQKALDI

SEQ ID NO: 173 - protein, 29 aa, Artificial Sequence
  Description of Artificial Sequence: Synthetic Human blood repeat domain
EAWCAAGNCFSLQREHDIAIKFFQRAIQV

SEQ ID NO: 174 - protein, 30 aa, Artificial Sequence
  Description of Artificial Sequence: Synthetic Human blood repeat domain
AQSCYSLGNTYTLLQDYEKAIDYHLKHLAI

SEQ ID NO: 175 - protein, 27 aa, Artificial Sequence
  Description of Artificial Sequence: Synthetic Human blood repeat domain
YSQLGNAYFYLHDYAKALEYHHHDLTL

SEQ ID NO: 176 - protein, 30 aa, Artificial Sequence
  Description of Artificial Sequence: Synthetic Human blood repeat domain
GRACWSLGNAYTALGNHDQAMHFAEKHLEI

SEQ ID NO: 177 - protein, 24 aa, Artificial Sequence
  Description of Artificial Sequence: Synthetic Human blood repeat domain
NMGNIYLKQRNYSKAIKFYRMALD

SEQ ID NO: 178 - protein, 26 aa, Artificial Sequence
  Description of Artificial Sequence: Synthetic Human blood repeat domain
ALTNKGNTVFANGDYEKAAEFYKEAL

SEQ ID NO: 179 - protein, 24 aa, Artificial Sequence
  Description of Artificial Sequence: Synthetic Human blood repeat domain
NMGNIYLKQRNYSKAIKFYRMALD

SEQ ID NO: 180 - protein, 26 aa, Artificial Sequence
  Description of Artificial Sequence: Synthetic Human blood repeat domain
ALTNKGNTVFANGDYEKAAEFYKEAL

SEQ ID NO: 181 - protein, 30 aa, Artificial Sequence
  Description of Artificial Sequence: Synthetic Human blood repeat domain
AQAWMNMGGIQHIKGKYVSARAYYERALQL

SEQ ID NO: 182 - protein, 30 aa, Artificial Sequence
  Description of Artificial Sequence: Synthetic Human blood repeat domain
AEILSPLGALYYNTGRYEEALQIYQEAAAL

SEQ ID NO: 183 - protein, 30 aa, Artificial Sequence
  Description of Artificial Sequence: Synthetic Human blood repeat domain
AQAAKNKGNKYFKAGKYEQAIQCYTEAISL

SEQ ID NO: 184 - protein, 25 aa, Artificial Sequence
  Description of Artificial Sequence: Synthetic Human blood repeat domain
YNLGKLYHEQGHYEEALSVYKEAIQ

SEQ ID NO: 185 - protein, 30 aa, Artificial Sequence; identical to SEQ ID NO: 181
  Description of Artificial Sequence: Synthetic Human blood repeat domain

SEQ ID NO: 186 - protein, 27 aa, Artificial Sequence
  Description of Artificial Sequence: Synthetic Human blood repeat domain
AEILSPLGALYYNTGRYEEALQIYQEA

SEQ ID NO: 187 - protein, 30 aa, Artificial Sequence
  Description of Artificial Sequence: Synthetic Human blood repeat domain
AETFKEQGNAYYAKKDYNEAYNYYTKAIDM

SEQ ID NO: 188 - protein, 28 aa, Artificial Sequence
  Description of Artificial Sequence: Synthetic Human blood repeat domain
AKAYARIGNSYFKEEKYKDAIHFYNKSL

SEQ ID NO: 189 - protein, 24 aa, Artificial Sequence
  Description of Artificial Sequence: Synthetic Human blood repeat domain
LGNDAYKKKDFDTALKHYDKAKEL

SEQ ID NO: 190 - protein, 23 aa, Artificial Sequence
  Description of Artificial Sequence: Synthetic Human blood repeat domain
NKGNECFQKGDYPQAMKHYTEAI

SEQ ID NO: 191 - protein, 30 aa, Artificial Sequence; identical to SEQ ID NO: 187
  Description of Artificial Sequence: Synthetic Human blood repeat domain

SEQ ID NO: 192 - protein, 28 aa, Artificial Sequence
  Description of Artificial Sequence: Synthetic Human blood repeat domain
AYSNLGNAHVFLGRFDVAAEYYKKTLQL

SEQ ID NO: 193 - protein, 28 aa, Artificial Sequence
  Description of Artificial Sequence: Synthetic Human blood repeat domain
AQACYSLGNTYTLLQDYERAAEYHLRHL

SEQ ID NO: 194 - protein, 30 aa, Artificial Sequence
  Description of Artificial Sequence: Synthetic Human blood repeat domain
AEELKTQANDYFKAKDYENAIKFYSQAIEL

SEQ ID NO: 195 - protein, 29 aa, Artificial Sequence
  Description of Artificial Sequence: Synthetic Human blood repeat domain
DAYKSLGQAYRELGNFEAATESFQKALLL

SEQ ID NO: 196 - protein, 29 aa, Artificial Sequence
  Description of Artificial Sequence: Synthetic Human blood repeat domain
ETLKNLAVLSYEGGDFEKAAELYKRAMEI

SEQ ID NO: 197 - protein, 22 aa, Artificial Sequence
  Description of Artificial Sequence: Synthetic Human blood repeat domain
GNKYFKQGKYDEAIDCYTKGMD

SEQ ID NO: 198 - protein, 21 aa, Artificial Sequence
  Description of Artificial Sequence: Synthetic Human blood repeat domain
GNGFFKEGKYERAIECYTRGI

SEQ ID NO: 199 - protein, 28 aa, Artificial Sequence
  Description of Artificial Sequence: Synthetic Human blood repeat domain
CWESLGEAYLSRGGYTTALKSFTKASEL

SEQ ID NO: 200 - protein, 26 aa, Artificial Sequence
  Description of Artificial Sequence: Synthetic Human blood repeat domain
KATYRAGIAFYHLGDYARALRYLQEA

SEQ ID NO: 201 - protein, 23 aa, Artificial Sequence
  Description of Artificial Sequence: Synthetic Human blood repeat domain
LGKIHLLEGDLDKAIEVYKKAVE

SEQ ID NO: 202 - protein, 24 aa, Artificial Sequence
  Description of Artificial Sequence: Synthetic Human blood repeat domain
LGDLFSKAGDFPRAAEAYQKQLRF

SEQ ID NO: 203 - protein, 28 aa, Artificial Sequence
  Description of Artificial Sequence: Synthetic Human blood repeat domain
AYFNAGNIYFHHRQFSQASDYFSKALKF

SEQ ID NO: 204 - protein, 27 aa, Artificial Sequence
  Description of Artificial Sequence: Synthetic Human blood repeat domain
EAWNQLGEVYWKKGDVAAAHTCFSGAL

SEQ ID NO: 205 - protein, 29 aa, Artificial Sequence
  Description of Artificial Sequence: Synthetic Human blood repeat domain
EAWQGLGEVLQAQGQNEAAVDCFLTALEL

SEQ ID NO: 206 - protein, 27 aa, Artificial Sequence
  Description of Artificial Sequence: Synthetic Human blood repeat domain
AKLWNNVGHALENEKNFERALKYFLQA

SEQ ID NO: 207 - protein, 30 aa, Artificial Sequence
  Description of Artificial Sequence: Synthetic Human blood repeat domain
ADLWYNLAIVHIELKEPNEALKNFNRALEL

SEQ ID NO: 208 - protein, 19 aa, Artificial Sequence
  Description of Artificial Sequence: Synthetic Human blood repeat domain
YRRKGDLDKAIELFQRVLE

SEQ ID NO: 209 - protein, 19 aa, Artificial Sequence
  Description of Artificial Sequence: Synthetic Human blood repeat domain
YRRKGDLDKAIELFQRVLE

SEQ ID NO: 210 - protein, 28 aa, Artificial Sequence
  Description of Artificial Sequence: Synthetic Human blood repeat domain
AKTYKDEGNDYFKEKDYKKAVISYTEGL

SEQ ID NO: 211 - protein, 30 aa, Artificial Sequence
  Description of Artificial Sequence: Synthetic Human blood repeat domain
AKVHYNIGKNLADKGNQTAAIRYYREAVRL

SEQ ID NO: 212 - protein, 30 aa, Artificial Sequence; identical to SEQ ID NO: 211
  Description of Artificial Sequence: Synthetic Human blood repeat domain

SEQ ID NO: 213 - protein, 21 aa, Artificial Sequence
  Description of Artificial Sequence: Synthetic Human blood repeat domain
GNELVKKGNHKKAIEKYSESL

SEQ ID NO: 214 - protein, 23 aa, Artificial Sequence
  Description of Artificial Sequence: Synthetic Human blood repeat domain
GNEQFKKGDYIEAESSYSRALEM

SEQ ID NO: 215 - protein, 29 aa, Artificial Sequence
  Description of Artificial Sequence: Synthetic Human blood repeat domain
ESLSLLGFVYKLEGNMNEALEYYERALRL

SEQ ID NO: 216 - protein, 29 aa, Artificial Sequence
  Description of Artificial Sequence: Synthetic Human blood repeat domain
ESLSLLGFVYKLEGNMNEALEYYERALRL

SEQ ID NO: 217 - protein, 28 aa, Artificial Sequence
  Description of Artificial Sequence: Synthetic Human blood repeat domain
AKTKNNLASAYLKQNKYQQAEELYKEIL

SEQ ID NO: 218 - protein, 27 aa, Artificial Sequence
  Description of Artificial Sequence: Synthetic Human blood repeat domain
WFSLGCAYLALEDYQGSAKAFQRCVTL

SEQ ID NO: 219 - protein, 30 aa, Artificial Sequence
  Description of Artificial Sequence: Synthetic Human blood repeat domain
AESCYQLARSFHVQEDYDQAFQYYYQATQF

SEQ ID NO: 220 - protein, 34 aa, Artificial Sequence
  Description of Artificial Sequence: Synthetic CTPRa-E. coli and human expression codon optimised
  MOD_RES (33)..(34): Xaa can be any naturally occurring amino acid
AEAWYNLGNAYYKQGDYQKAIEYYQKALELDPXX

SEQ ID NO: 221 - protein, 34 aa, Artificial Sequence
  Description of Artificial Sequence: Synthetic RTPRa (i and ii) H sapiens and RTPRa (i - iv) E coli expression codon optimised
  MOD_RES (33)..(34): Xaa can be any naturally occurring amino acid
AEAWYNLGNAYYRQGDYQRAIEYYQRALELDPXX

SEQ ID NO: 222 - protein, 34 aa, Artificial Sequence
  Description of Artificial Sequence: Synthetic CTPRb E coli and H sapiens expression codon optimised
  MOD_RES (33)..(34): Xaa can be any naturally occurring amino acid
AEALNNLGNVYREQGDYQKAIEYYQKALELDPXX

SEQ ID NO: 223 - protein, 34 aa, Artificial Sequence
  Description of Artificial Sequence: Synthetic RTPRb E. coli expression colon optimised
  MOD_RES (33)..(34): Xaa can be any naturally occurring amino acid
AEALNNLGNVYREQGDYQRAIEYYQRALELDPXX

SEQ ID NO: 224 - protein, 34 aa, Artificial Sequence; identical to SEQ ID NO: 223
  Description of Artificial Sequence: Synthetic RTPRb H sapiens expression codon optimised
  MOD_RES (33)..(34): Xaa can be any naturally occurring amino acid

SEQ ID NO: 225 - protein, 34 aa, Artificial Sequence
  Description of Artificial Sequence: Synthetic RTPRc E coli and H sapiens expression codon optimised
  MOD_RES (33)..(34): Xaa can be any naturally occurring amino acid
AEALRNLGRVYRRQGRYQRAIEYYRRALELDPXX

SEQ ID NO: 226 - protein, 11 aa, Artificial Sequence
  Description of Artificial Sequence: Synthetic Parotope for protein target Nrp1/2
RASQYFSSYLA

SEQ ID NO: 227 - protein, 16 aa, Artificial Sequence
  Description of Artificial Sequence: Synthetic Parotope for protein target Nrp1/2
AREDFRNRRLWYVMDY

SEQ ID NO: 228 - protein, 13 aa, Artificial Sequence
  Description of Artificial Sequence: Synthetic Parotope for protein target IL18
KASGYSFTDYFIY

SEQ ID NO: 229 - protein, 8 aa, Artificial Sequence
  Description of Artificial Sequence: Synthetic Parotope for protein target IL15
YRDRRRPS

SEQ ID NO: 230 - protein, 13 aa, Artificial Sequence
  Description of Artificial Sequence: Synthetic Parotope for protein target Thyroid stimulating hormone receptor
SGSSSDIGSNYVS

SEQ ID NO: 231 - protein, 9 aa, Artificial Sequence
  Description of Artificial Sequence: Synthetic Parotope for protein target EGF receptor
QQWSSHIFT

SEQ ID NO: 232 - protein, 14 aa, Artificial Sequence
  Description of Artificial Sequence: Synthetic Parotope for protein target EGF receptor
ASRDYDYAGRYFDY

SEQ ID NO: 233 - protein, 9 aa, Artificial Sequence
  Description of Artificial Sequence: Synthetic Parotope for protein target IL23
QNGHSFPFT

SEQ ID NO: 234 - protein, 10 aa, Artificial Sequence
  Description of Artificial Sequence: Synthetic Parotope for protein target IL23
YINPYNDGTK

SEQ ID NO: 235 - protein, 8 aa, Artificial Sequence
  Description of Artificial Sequence: Synthetic Parotope for protein target IL23
ARNWDVAY

SEQ ID NO: 236 - protein, 11 aa, Artificial Sequence
  Description of Artificial Sequence: Synthetic Parotope for protein target Lymphocyte function associated antigen 1 (LFA-1)
SGYSFTGHWMN

SEQ ID NO: 237 - protein, 10 aa, Artificial Sequence
  Description of Artificial Sequence: Synthetic Parotope for protein target Lymphocyte function associated antigen (LFA-1)
MIHPSDSETR

SEQ ID NO: 238 - protein, 14 aa, Artificial Sequence
  Description of Artificial Sequence: Synthetic Parotope for protein target Lymphocyte function associated antigen 1 (LFA-1)
ARGIYFYGTTYFDY

SEQ ID NO: 239 - protein, 10 aa, Artificial Sequence
  Description of Artificial Sequence: Synthetic Parotope for protein target C3b
SGFSFTSSVS

SEQ ID NO: 240 - protein, 9 aa, Artificial Sequence
  Description of Artificial Sequence: Synthetic Parotope for protein target C3b
LIYPYNGFN

SEQ ID NO: 241 - protein, 13 aa, Artificial Sequence
  Description of Artificial Sequence: Synthetic Parotope for protein target FGF receptor 3
AASGFTFTSTGIS

SEQ ID NO: 242 - protein, 15 aa, Artificial Sequence
  Description of Artificial Sequence: Synthetic Parotope for protein target FGF receptor 3
ARTYGIYDLYVDYTE

SEQ ID NO: 243 - protein, 9 aa, Artificial Sequence
  Description of Artificial Sequence: Synthetic Parotope for protein target IL2
SRDYGYYFD

SEQ ID NO: 244 - protein, 10 aa, Artificial Sequence
  Description of Artificial Sequence: Synthetic Parotope for protein target IL2
GYSFTRYWMH

SEQ ID NO: 245 - protein, 8 aa, Artificial Sequence
  Description of Artificial Sequence: Synthetic Parotope for protein target HER3
QWWWWPST

SEQ ID NO: 246 - protein, 12 aa, Artificial Sequence
  Description of Artificial Sequence: Synthetic Parotope for protein target Her2
ASGFSIWWSWIH

SEQ ID NO: 247 - protein, 8 aa, Artificial Sequence
  Description of Artificial Sequence: Synthetic Parotope for protein target membrane-type serine protease 1
YDNNQRPS

SEQ ID NO: 248 - protein, 17 aa, Artificial Sequence
  Description of Artificial Sequence: Synthetic Parotope for protein target membrane-type serine protease 1
TFHIRRYRSGYYDKMDH

SEQ ID NO: 249 - protein, 12 aa, Artificial Sequence
  Description of Artificial Sequence: Synthetic Parotope for protein target beta-secretase
ARGPFSPWVMDY

SEQ ID NO: 250 - protein, 9 aa, Artificial Sequence
  Description of Artificial Sequence: Synthetic Parotope for protein target VEGF-R
TRHDGTNFD

SEQ ID NO: 251 - protein, 9 aa, Artificial Sequence
  Description of Artificial Sequence: Synthetic Parotope for protein target VEGF-R
QQAKAFPPT

SEQ ID NO: 252 - protein, 12 aa, Artificial Sequence
  Description of Artificial Sequence: Synthetic Parotope for protein target Irp5/6 receptor
SGHVNAVKNYGY

SEQ ID NO: 253 - protein, 8 aa, Artificial Sequence
  Description of Artificial Sequence: Synthetic Parotope for protein target hepsin protease
WINTETGS

SEQ ID NO: 254 - protein, 8 aa, Artificial Sequence
  Description of Artificial Sequence: Synthetic Parotope for protein target Factor D
WINTYTGE

SEQ ID NO: 255 - protein, 10 aa, Artificial Sequence
  Description of Artificial Sequence: Synthetic Parotope for protein target Factor D
GYTFTNYGMN

SEQ ID NO: 256 - protein, 148 aa, Artificial Sequence
  Description of Artificial Sequence: Synthetic Axin - RTPR- ABBA
MGSGAYPEYILDIHVYRVQLELDPNNAEAWYNLGNAYYRQGDYQRAIEYYQRALELDPNNAEAWYNLGNAYYRQGDYQRAIEYYQRALELDPGGSLSSAFHVFEDGNKENGGPNAEAWYNLGNAYYRQGDYQRAIEYYQRALELDPNN

SEQ ID NO: 257 - protein, 143 aa, Artificial Sequence
  Description of Artificial Sequence: Synthetic Axin - RTPR - DBOX
MGSGAYPEYILDIHVYRVQLELDPNNAEAWYNLGNAYYRQGDYQRAIEYYQRALELDPNNAEAWYNLGNAYYRQGDYQRAIEYYQRALELDPGGPRLPLGDVSNNGGPNAEAWYNLGNAYYRQGDYQRAIEYYQRALELDPNN

SEQ ID NO: 258 - protein, 143 aa, Artificial Sequence; identical to SEQ ID NO: 257
  Description of Artificial Sequence: Synthetic Axin - RTPR - KEN

SEQ ID NO: 259 - protein, 143 aa, Artificial Sequence; identical to SEQ ID NO: 257
  Description of Artificial Sequence: Synthetic Axin-RTPR-Nrf2

SEQ ID NO: 260 - protein, 143 aa, Artificial Sequence
  Description of Artificial Sequence: Synthetic Axin-RTPR-SIAH
MGSGAYPEYILDIHVYRVQLELDPNNAEAWYNLGNAYYRQGDYQRAIEYYQRALELDPNNAEAWYNLGNAYYRQGDYQRAIEYYQRALELDPGGLRPVAMVRPTVGGPNAEAWYNLGNAYYRQGDYQRAIEYYQRALELDPNN

SEQ ID NO: 261 - protein, 113 aa, Artificial Sequence
  Description of Artificial Sequence: Synthetic Axin-RTPR-SPOP
MGSGAYPEYILDIHVYRVQLELDPNNAEAWYNLGNAYYRQGDYQRAIEYYQRALELDPGGLACDEVTSTTSSSTAGGPNAEAWYNLGNAYYRQGDYQRAIEYYQRALELDPNN

SEQ ID NO: 262 - protein, 142 aa, Artificial Sequence
  Description of Artificial Sequence: Synthetic Axin-RTPR-p27
MGSGAYPEYILDIHVYRVQLELDPNNAEAWYNLGNAYYRQGDYQRAIEYYQRALELDPNNAEAWYNLGNAYYRQGDYQRAIEYYQRALELDPNNAGSNEQEPKKRSPDAEAWYNLGNAYYRQGDYQRAIEYYQRALELDPNN

SEQ ID NO: 263 - protein, 106 aa, Artificial Sequence
  Description of Artificial Sequence: Synthetic Axin-RTPR-p53
MGSGAYPEYILDIHVYRVQLELDPNNAEAWYNLGNAYYRQGDYQRAIEYYQRALELDPNNAEAWYNLGNAYYRQGDYQRAIEYYQRALELDPNNFAAYWNLLSAYG

SEQ ID NO: 264 - protein, 142 aa, Artificial Sequence
  Description of Artificial Sequence: Synthetic Bcl9-RTPR-ABBA
MGSSQEQLEHRYRSLITLYDIQLMLDPNNAEAWYNLGNAYYRQGDYQRAIEYYQRALELDPNNAEAWYNLGNAYYRQGDYQRAIEYYQRALELDPGGDPETGELGGPNAEAWYNLGNAYYRQGDYQRAIEYYQRALELDPNN

SEQ ID NO: 265 - protein, 146 aa, Artificial Sequence
  Description of Artificial Sequence: Synthetic Bcl9-RTPR-DBOX-v1
MGSSQEQLEHRYRSLITLYDIQLMLDPNNAEAWYNLGNAYYRQGDYQRAIEYYQRALELDPNNAEAWYNLGNAYYRQGDYQRAIEYYQRALELDPGGPRLPLGDVSNNGGPNAEAWYNLGNAYYRQGDYQRAIEYYQRALELDPNN

SEQ ID NO: 266 - protein, 112 aa, Artificial Sequence
  Description of Artificial Sequence: Synthetic Bcl9-RTPR-DBOX-v2
MGSSQEQLEHRYRSLITLYDIQLMLDPNNAEAWYNLGNAYYRQGDYQRAIEYYQRALELDPGGPRLPLGDVSNNGGPNAEAWYNLGNAYYRQGDYQRAIEYYQRALELDPNN

SEQ ID NO: 267 - protein, 148 aa, Artificial Sequence; identical to SEQ ID NO: 256
  Description of Artificial Sequence: Synthetic Bcl9-RTPR-KEN

SEQ ID NO: 268 - protein, 142 aa, Artificial Sequence; identical to SEQ ID NO: 264
  Description of Artificial Sequence: Synthetic Bcl9-RTPR-Nrf2

SEQ ID NO: 269 - protein, 145 aa, Artificial Sequence
  Description of Artificial Sequence: Synthetic Bcl9-RTPR-p27
MGSSQEQLEHRYRSLITLYDIQLMLDPNNAEAWYNLGNAYYRQGDYQRAIEYYQRALELDPNNAEAWYNLGNAYYRQGDYQRAIEYYQRALELDPNNAGSNEQEPKKRSPDAEAWYNLGNAYYRQGDYQRAIEYYQRALELDPNN

SEQ ID NO: 270 - protein, 109 aa, Artificial Sequence
  Description of Artificial Sequence: Synthetic Bcl9-RTPR-p53
MGSSQEQLEHRYRSLITLYDIQLMLDPNNAEAWYNLGNAYYRQGDYQRAIEYYQRALELDPNNAEAWYNLGNAYYRQGDYQRAIEYYQRALELDPNNFAAYWNLLSAYG

SEQ ID NO: 271 - protein, 146 aa, Artificial Sequence
  Description of Artificial Sequence: Synthetic Bcl9-RTPR-SIAH
MGSSQEQLEHRYRSLITLYDIQLMLDPNNAEAWYNLGNAYYRQGDYQRAIEYYQRALELDPNNAEAWYNLGNAYYRQGDYQRAIEYYQRALELDPGGLRPVAMVRPTVGGPNAEAWYNLGNAYYRQGDYQRAIEYYQRALELDPNN

SEQ ID NO: 272 - protein, 116 aa, Artificial Sequence
  Description of Artificial Sequence: Synthetic Bcl9-RTPR-SPOP
MGSSQEQLEHRYRSLITLYDIQLMLDPNNAEAWYNLGNAYYRQGDYQRAIEYYQRALELDPGGLACDEVTSTTSSSTAGGPNAEAWYNLGNAYYRQGDYQRAIEYYQRALELDPNN

SEQ ID NO: 273 - protein, 173 aa, Artificial Sequence
  Description of Artificial Sequence: Synthetic TCF7L2-RTPR-Nrf2
MGSAEAWYNLGNAYYRQGDYQRAIEYYQRALELDPGGQELGDNDELMHFSYESTQDGGPNAEAWYNLGNAYYRQGDYQRAIEYYQRALELDPNNAEAWYNLGNAYYRQGDYQRAIEYYQRALELDPGGDPETGELGGPNAEAWYNLGNAYYRQGDYQRAIEYYQRALELDPNN

SEQ ID NO: 274 - protein, 176 aa, Artificial Sequence
  Description of Artificial Sequence: Synthetic TCF7L2-RTPR-p27
MGSAEAWYNLGNAYYRQGDYQRAIEYYQRALELDPGGQELGDNDELMHFSYESTQDGGPNAEAWYNLGNAYYRQGDYQRAIEYYQRALELDPNNAEAWYNLGNAYYRQGDYQRAIEYYQRALELDPNNAGSNEQEPKKRSPDAEAWYNLGNAYYRQGDYQRAIEYYQRALELDPNN

SEQ ID NO: 275 - protein, 190 aa, Artificial Sequence
  Description of Artificial Sequence: Synthetic p27-RTPR-TCF7L2
MRGSHHHHHHGLVPRGSAEAWYNLGNAYYRQGDYQRAIEYYQRALELDPNNAGSNEQEPKKRSPDAEAWYNLGNAYYRQGDYQRAIEYYQRALELDPRSAEAWYNLGNAYYRQGDYQRAIEYYQRALELDPGGQELGDNDELMHFSYESTQDGGPNAEAWYNLGNAYYRQGDYQRAIEYYQRALELDPRS

SEQ ID NO: 276 - protein, 140 aa, Artificial Sequence
  Description of Artificial Sequence: Synthetic TCF7L2-RTPR-p53
MGSAEAWYNLGNAYYRQGDYQRAIEYYQRALELDPGGQELGDNDELMHFSYESTQDGGPNAEAWYNLGNAYYRQGDYQRAIEYYQRALELDPNNAEAWYNLGNAYYRQGDYQRAIEYYQRALELDPNNFAAYWNLLSAYG

SEQ ID NO: 277 - protein, 139 aa, Artificial Sequence
  Description of Artificial Sequence: Synthetic ICAT-RTPR-p27
MGSYAYQRAIVEYMLRLMSDPNNAEAWYNLGNAYYRQGDYQRAIEYYQRALELDPNNAEAWYNLGNAYYRQGDYQRAIEYYQRALELDPNNAGSNEQEPKKRSPDAEAWYNLGNAYYRQGDYQRAIEYYQRALELDPNN

SEQ ID NO: 278 - protein, 103 aa, Artificial Sequence
  Description of Artificial Sequence: Synthetic ICAT-RTPR-p53
MGSYAYQRAIVEYMLRLMSDPNNAEAWYNLGNAYYRQGDYQRAIEYYQRALELDPNNAEAWYNLGNAYYRQGDYQRAIEYYQRALELDPNNFAAYWNLLSAYG

SEQ ID NO: 279 - protein, 136 aa, Artificial Sequence
  Description of Artificial Sequence: Synthetic LRH1-RTPR-ABBA
MGSYEQAIAAYLDALMCDPNNAEAWYNLGNAYYRQGDYQRAIEYYQRALELDPNNAEAWYNLGNAYYRQGDYQRAIEYYQRALELDPGGSEDKENVPPGGPNAEAWYNLGNAYYRQGDYQRAIEYYQRALELDPNN

SEQ ID NO: 280 - protein, 138 aa, Artificial Sequence
  Description of Artificial Sequence: Synthetic LRH1-RTPR-DBOX
MGSYEQAIAAYLDALMCDPNNAEAWYNLGNAYYRQGDYQRAIEYYQRALELDPNNAEAWYNLGNAYYRQGDYQRAIEYYQRALELDPGGPRLPLGDVSNNGGPNAEAWYNLGNAYYRQGDYQRAIEYYQRALELDPNN

SEQ ID NO: 281 - protein, 136 aa, Artificial Sequence; identical to SEQ ID NO: 279
  Description of Artificial Sequence: Synthetic LRH1-RTPR-KEN

SEQ ID NO: 282 - protein, 134 aa, Artificial Sequence
  Description of Artificial Sequence: Synthetic LRH1-RTPR-Nrf2
MGSYEQAIAAYLDALMCDPNNAEAWYNLGNAYYRQGDYQRAIEYYQRALELDPNNAEAWYNLGNAYYRQGDYQRAIEYYQRALELDPGGDPETGELGGPNAEAWYNLGNAYYRQGDYQRAIEYYQRALELDPNN

SEQ ID NO: 283 - protein, 137 aa, Artificial Sequence
  Description of Artificial Sequence: Synthetic LRH1-RTPR-p27
MGSYEQAIAAYLDALMCDPNNAEAWYNLGNAYYRQGDYQRAIEYYQRALELDPNNAEAWYNLGNAYYRQGDYQRAIEYYQRALELDPNNAGSNEQEPKKRSPDAEAWYNLGNAYYRQGDYQRAIEYYQRALELDPNN

SEQ ID NO: 284 - protein, 101 aa, Artificial Sequence
  Description of Artificial Sequence: Synthetic LRH1-RTPR-p53
MGSYEQAIAAYLDALMCDPNNAEAWYNLGNAYYRQGDYQRAIEYYQRALELDPNNAEAWYNLGNAYYRQGDYQRAIEYYQRALELDPNNFAAYWNLLSAYG

SEQ ID NO: 285 - protein, 138 aa, Artificial Sequence
  Description of Artificial Sequence: Synthetic LRH1-RTPR-SIAH
MGSYEQAIAAYLDALMCDPNNAEAWYNLGNAYYRQGDYQRAIEYYQRALELDPNNAEAWYNLGNAYYRQGDYQRAIEYYQRALELDPGGLRPVAMVRPTVGGPNAEAWYNLGNAYYRQGDYQRAIEYYQRALELDPNN

SEQ ID NO: 286 - protein, 142 aa, Artificial Sequence
  Description of Artificial Sequence: Synthetic LRH1-RTPR-SPOP
MGSYEQAIAAYLDALMCDPNNAEAWYNLGNAYYRQGDYQRAIEYYQRALELDPNNAEAWYNLGNAYYRQGDYQRAIEYYQRALELDPGGLACDEVTSTTSSSTAGGPNAEAWYNLGNAYYRQGDYQRAIEYYQRALELDPNN

SEQ ID NO: 287 - protein, 170 aa, Artificial Sequence
  Description of Artificial Sequence: Synthetic APC-RTPR-Nrf2
MGSAEAWYNLGNAYYRQGDYQRAIEYYQRALELDPGGSCSEELEALEALELDEGGPNAEAWYNLGNAYYRQGDYQRAIEYYQRALELDPNNAEAWYNLGNAYYRQGDYQRAIEYYQRALELDPGGDPETGELGGPNAEAWYNLGNAYYRQGDYQRAIEYYQRALELDPNN

SEQ ID NO: 288 - protein, 91 aa, Artificial Sequence
  Description of Artificial Sequence: Synthetic APC-RTPR-p27
MGSAEAWYNLGNAYYRQGDYQRAIEYYQRALELDPGGSCSEELEALEALELDEGGPNAEAWYNLGNAYYRQGDYQRAIEYYQRALELDPNN

SEQ ID NO: 289 - protein, 187 aa, Artificial Sequence
  Description of Artificial Sequence: Synthetic p27-RTPR-APC
MRGSHHHHHHGLVPRGSAEAWYNLGNAYYRQGDYQRAIEYYQRALELDPNNAGSNEQEPKKRSPDAEAWYNLGNAYYRQGDYQRAIEYYQRALELDPRSAEAWYNLGNAYYRQGDYQRAIEYYQRALELDPGGSCSEELEALEALELDEGGPNAEAWYNLGNAYYRQGDYQRAIEYYQRALELDPRS

SEQ ID NO: 290 - protein, 140 aa, Artificial Sequence; identical to SEQ ID NO: 276
  Description of Artificial Sequence: Synthetic APC-RTPR-p53

SEQ ID NO: 291 - protein, 83 aa, Artificial Sequence
  Description of Artificial Sequence: Synthetic 1TBP-CTPR2
MGSAEAWYNLGNAYYKQGDYQKAIEYYQKALELDPNNREAGDGEEDPRSAEAWYNLGNAYYKQGDYQKAIEYYQKALELDPRS

SEQ ID NO: 292 - protein, 163 aa, Artificial Sequence
  Description of Artificial Sequence: Synthetic 2TBP-CTPR4
MGSAEAWYNLGNAYYKQGDYQKAIEYYQKALELDPNNREAGDGEEDPRSAEAWYNLGNAYYKQGDYQKAIEYYQKALELDPRSAEAWYNLGNAYYKQGDYQKAIEYYQKALELDPNNREAGDGEEDPRSAEAWYNLGNAYYKQGDYQKAIEYYQKALELDPRS

SEQ ID NO: 293 - protein, 243 aa, Artificial Sequence
  Description of Artificial Sequence: Synthetic 3TBP-CTPR6
MGSAEAWYNLGNAYYKQGDYQKAIEYYQKALELDPNNREAGDGEEDPRSAEAWYNLGNAYYKQGDYQKAIEYYQKALELDPRSAEAWYNLGNAYYKQGDYQKAIEYYQKALELDPNNREAGDGEEDPRSAEAWYNLGNAYYKQGDYQKAIEYYQKALELDPRSAEAWYNLGNAYYKQGDYQKAIEYYQKALELDPNNREAGDGEEDPRSAEAWYNLGNAYYKQGDYQKAIEYYQKALELDPRS

SEQ ID NO: 294 - protein, 323 aa, Artificial Sequence
  Description of Artificial Sequence: Synthetic 4TBP-CTPR8
MGSAEAWYNLGNAYYKQGDYQKAIEYYQKALELDPNNREAGDGEEDPRSAEAWYNLGNAYYKQGDYQKAIEYYQKALELDPRSAEAWYNLGNAYYKQGDYQKAIEYYQKALELDPNNREAGDGEEDPRSAEAWYNLGNAYYKQGDYQKAIEYYQKALELDPRSAEAWYNLGNAYYKQGDYQKAIEYYQKALELDPNNREAGDGEEDPRSAEAWYNLGNAYYKQGDYQKAIEYYQKALELDPRSAEAWYNLGNAYYKQGDYQKAIEYYQKALELDPNNREAGDGEEDPRSAEAWYNLGNAYYKQGDYQKAIEYYQKALELDPRS

SEQ ID NO: 295 - protein, 130 aa, Artificial Sequence
  Description of Artificial Sequence: Synthetic 1TBP-CTPR2-Foldon
MGSAEAWYNLGNAYYKQGDYQKAIEYYQKALELDPNNREAGDGEEDPRSAEAWYNLGNAYYKQGDYQKAIEYYQKALELDPRSAKASLNLANADIKTIQEAGYIPEAPRDGQAYVRKDGEWVLLSTFLRS

SEQ ID NO: 296 - protein, 210 aa, Artificial Sequence
  Description of Artificial Sequence: Synthetic 2TBP-CTPR4-Foldon
MGSAEAWYNLGNAYYKQGDYQKAIEYYQKALELDPNNREAGDGEEDPRSAEAWYNLGNAYYKQGDYQKAIEYYQKALELDPRSAEAWYNLGNAYYKQGDYQKAIEYYQKALELDPNNREAGDGEEDPRSAEAWYNLGNAYYKQGDYQKAIEYYQKALELDPRSAKASLNLANADIKTIQEAGYIPEAPRDGQAYVRKDGEWVLLSTFLRS

SEQ ID NO: 297 - protein, 290 aa, Artificial Sequence
  Description of Artificial Sequence: Synthetic 3TBP-CTPR6-Foldon
MGSAEAWYNLGNAYYKQGDYQKAIEYYQKALELDPNNREAGDGEEDPRSAEAWYNLGNAYYKQGDYQKAIEYYQKALELDPRSAEAWYNLGNAYYKQGDYQKAIEYYQKALELDPNNREAGDGEEDPRSAEAWYNLGNAYYKQGDYQKAIEYYQKALELDPRSAEAWYNLGNAYYKQGDYQKAIEYYQKALELDPNNREAGDGEEDPRSAEAWYNLGNAYYKQGDYQKAIEYYQKALELDPRSAKASLNLANADIKTIQEAGYIPEAPRDGQAYVRKDGEWVLLSTFLRS

SEQ ID NO: 298 - protein, 370 aa, Artificial Sequence
  Description of Artificial Sequence: Synthetic 4TBP-CTPR8-Foldon
MGSAEAWYNLGNAYYKQGDYQKAIEYYQKALELDPNNREAGDGEEDPRSAEAWYNLGNAYYKQGDYQKAIEYYQKALELDPRSAEAWYNLGNAYYKQGDYQKAIEYYQKALELDPNNREAGDGEEDPRSAEAWYNLGNAYYKQGDYQKAIEYYQKALELDPRSAEAWYNLGNAYYKQGDYQKAIEYYQKALELDPNNREAGDGEEDPRSAEAWYNLGNAYYKQGDYQKAIEYYQKALELDPRSAEAWYNLGNAYYKQGDYQKAIEYYQKALELDPNNREAGDGEEDPRSAEAWYNLGNAYYKQGDYQKAIEYYQKALELDPRSAKASLNLANADIKTIQEAGYIPEAPRDGQAYVRKDGEWVLLSTFLRS

SEQ ID NO: 299 - protein, 129 aa, Artificial Sequence
  Description of Artificial Sequence: Synthetic KBL -RTPR-CMA_Q
MGSIPNPLLGLDGSAEAWYNLGNAYYRQGDYQRAIEYYQRALELDPNNPLYISYDPAEAWYNLGNAYYRQGDYQRAIEYYQRALELDPRSAEAWYNLGNAYYRQGDYQRAIEYYQRALELDPNNQRFFE

SEQ ID NO: 300 - protein, 120 aa, Artificial Sequence
  Description of Artificial Sequence: Synthetic CMA_Q-KBL-RTPR
MGSQRFFEGSAEAWYNLGNAYYRQGDYQRAIEYYQRALELDPNNPLYISYDPAEAWYNLGNAYYRQGDYQRAIEYYQRALELDPRSAEAWYNLGNAYYRQGDYQRAIEYYQRALELDPNN

SEQ ID NO: 301 - protein, 120 aa, Artificial Sequence
  Description of Artificial Sequence: Synthetic CMA_K-KBL-RTPR
MGSKFERQGSAEAWYNLGNAYYRQGDYQRAIEYYQRALELDPNNPLYISYDPAEAWYNLGNAYYRQGDYQRAIEYYQRALELDPRSAEAWYNLGNAYYRQGDYQRAIEYYQRALELDPNN

SEQ ID NO: 302 - protein, 95 aa, Artificial Sequence
  Description of Artificial Sequence: Synthetic SOS-RTPR-CMA_K
MGSFEGIALTNYLKALEGDPNNAEAWYNLGNAYYRQGDYQRAIEYYQRALELDPNNAEAWYNLGNAYYRQGDYQRAIEYYQRALELDPRSKFERQ

SEQ ID NO: 303 - protein, 70 aa, Artificial Sequence
  Description of Artificial Sequence: Synthetic SOS-RTPR-CMA_Q
MGSFEGIALTNYLKALEGDPNNAEAWYNLGNAYYRQGDYQRAIEYYQRALELDPRSIPNPLLGLDKFERQ

SEQ ID NO: 304 - protein, 172 aa, Artificial Sequence
  Description of Artificial Sequence: Synthetic SOS-RTPR-p27
MGSFEGIALTNYLKALEGDPNNAEAWYNLGNAYYRQGDYQRAIEYYQRALELDPNNAEAWYNLGNAYYRQGDYQRAIEYYQRALELDPRSAEAWYNLGNAYYRQGDYQRAIEYYQRALELDPNNAGSNEQEPKKRSPDAEAWYNLGNAYYRQGDYQRAIEYYQRALELDPRS

SEQ ID NO: 305 - protein, 159 aa, Artificial Sequence
  Description of Artificial Sequence: Synthetic KBL-RTPR-p27
MGSAEAWYNLGNAYYRQGDYQRAIEYYQRALELDPNNPLYISYDPAEAWYNLGNAYYRQGDYQRAIEYYQRALELDPRSAEAWYNLGNAYYRQGDYQRAIEYYQRALELDPNNAGSNEQEPKKRSAEAWYNLGNAYYRQGDYQRAIEYYQRALELDPNN

SEQ ID NO: 306 - skipped

SEQ ID NO: 307 - protein, 34 aa, Artificial Sequence
  Description of Artificial Sequence: Synthetic modular binding protein repeat domain
  MOD_RES (31)..(34): Xaa is independently any amino acid or variant thereof
AEALNNLGNVYREQGDYQKAIEYYQKALELXXXX

SEQ ID NO: 308 - protein, 34 aa, Artificial Sequence
  Description of Artificial Sequence: Synthetic modular binding protein repeat domain
  MOD_RES (31)..(34): Xaa is independently any amino acid or a variant thereof
AEALRNLGRVYRRQGRYQRAIEYYRRALELXXXX

SEQ ID NO: 309 - protein, 34 aa, Artificial Sequence
  Description of Artificial Sequence: Synthetic segment of S75991
ALTLNNIGTIYYAREDYDQALNYYEQALSLSRAV

SEQ ID NO: 310 - protein, 34 aa, Artificial Sequence
  Description of Artificial Sequence: Synthetic segment of 2407639-54
AEELKEQANEYFRVKDYDHAVQYYTQAIDLSPDT

SEQ ID NO: 311 - protein, 34 aa, Artificial Sequence
  Description of Artificial Sequence: Synthetic segment of YDAB_MY
WRAWFRLGLAYDGAGDRRRAREAIRRAITLEKNP

SEQ ID NO: 312 - protein, 34 aa, Artificial Sequence
  Description of Artificial Sequence: Synthetic segment of GSIA_BA
SSALYNLGNCYEKMGELQKAAEYFGKSVSICKSE

SEQ ID NO: 313 - protein, 34 aa, Artificial Sequence
  Description of Artificial Sequence: Synthetic segment of E64417
VPMWVKKAEILRKLGRYEDALLCLNRALELKPHD

SEQ ID NO: 314 - protein, 34 aa, Artificial Sequence
  Description of Artificial Sequence: Synthetic segment of A56519
EPLLNNLGHVCRKLKKYAEALDYHRQALVLIPQN

SEQ ID NO: 315 - protein, 34 aa, Artificial Sequence
  Description of Artificial Sequence: Synthetic segment of DMUNKNOWN_1-96
EKVYFNLGMLAMDESSFDEAEQFFKRAIHLKADF

SEQ ID NO: 316 - protein, 34 aa, Artificial Sequence
  Description of Artificial Sequence: Synthetic segment of SPAC6B12_12-516
SEVYNYFGEILLDQQKFDDAVKNFDHAIELEKRE

SEQ ID NO: 317 - protein, 34 aa, Artificial Sequence
  Description of Artificial Sequence: Synthetic segment of NUC2_SC
PESWCILANCFSLQREHSQALKCINRAIQLDPTF

SEQ ID NO: 318 - protein, 34 aa, Artificial Sequence
  Description of Artificial Sequence: Synthetic segment of CELZK320
ARICNLQAELLYRRREFSQAVDICKQALAYHETD

SEQ ID NO: 319 - protein, 34 aa, Artificial Sequence
  Description of Artificial Sequence: Synthetic segment of NFRA_EC
ANAYVARATIYRQRHNVPAAVSDLRAALELEPNN

SEQ ID NO: 320 - protein, 34 aa, Artificial Sequence
  Description of Artificial Sequence: Synthetic segment of CCU2886
GLAWHILAIAREKTGDFASSLRAYEAALALLPDH

SEQ ID NO: 321 - protein, 34 aa, Artificial Sequence
  Description of Artificial Sequence: Synthetic segment of S766850
FELHYHLANAYRRQQKWELARKHYQKALDEEILL

SEQ ID NO: 322 - protein, 34 aa, Artificial Sequence
  Description of Artificial Sequence: Synthetic segment of CELT19A
VAIHFTLGNIYASIGDYQRALNFYYSTLSLQANF

SEQ ID NO: 323 - protein, 34 aa, Artificial Sequence
  Description of Artificial Sequence: Synthetic segment of S766851
AEAYQNLAVTSFKAGLIQESVDAFQQAIALYEQR

SEQ ID NO: 324 - protein, 34 aa, Artificial Sequence
  Description of Artificial Sequence: Synthetic segment of S75601
YKGWYQQGNTLWQQGKYNDALLSYERALEYYPGD

SEQ ID NO: 325 - protein, 34 aa, Artificial Sequence
  Description of Artificial Sequence: Synthetic segment of YHBM_EC
PEVFNYLGIYLTQAGNFDAAYEAFDSVLELDPTY

SEQ ID NO: 326 - protein, 34 aa, Artificial Sequence
  Description of Artificial Sequence: Synthetic segment of HSU4203
EKGLYRRGEAQLLMNEFESAKGDFEKVLEVNPQN

SEQ ID NO: 327 - protein, 34 aa, Artificial Sequence
  Description of Artificial Sequence: Synthetic segment of YKD1_CA
ADLRVGIGHCFAKMGMMDKAKTAFERAMEIEPYN

SEQ ID NO: 328 - protein, 34 aa, Artificial Sequence
  Description of Artificial Sequence: Synthetic segment of CELZK32
PGSYSLLGDAFMKVQEPEDAINFYEQALKMQSKD

SEQ ID NO: 329 - protein, 34 aa, Artificial Sequence
  Description of Artificial Sequence: Synthetic segment of S56658
SKGYTRKGAVQFSMKEYDKALETYREGLKHDPNN

SEQ ID NO: 330 - protein, 34 aa, Artificial Sequence
  Description of Artificial Sequence: Synthetic segment of G02540
AQSCYSLGNTYTLLQDYEKAIDYHLKHLAIAQEL

SEQ ID NO: 331 - protein, 34 aa, Artificial Sequence
  Description of Artificial Sequence: Synthetic segment of CELC55B
ADILCERAEAHILDEDYDSAIEDYQKATEVNPDH

SEQ ID NO: 332 - protein, 34 aa, Artificial Sequence
  Description of Artificial Sequence: Synthetic segment of CELF30H
PVLYRNRAMARLKRDDFEGAQSDCTKALEFDGAD

SEQ ID NO: 333 - protein, 34 aa, Artificial Sequence
  Description of Artificial Sequence: Synthetic segment of B55508
VESTSLLGLVYKLKGQEKNALFYYEKALRLTGEM

SEQ ID NO: 334 - protein, 34 aa, Artificial Sequence
  Description of Artificial Sequence: Synthetic segment of SMU5458
TDCLYHLAVGFLKLNDYHNATIYCQCLLTIEPDN

SEQ ID NO: 335 - protein, 34 aa, Artificial Sequence
  Description of Artificial Sequence: Synthetic segment of BSTHRZ1
GRTLYNIGLCKNSQSQYEDAIPYFKRAIAVFEES

SEQ ID NO: 336 - protein, 34 aa, Artificial Sequence
  Description of Artificial Sequence: Synthetic segment of PSEPILF
SRVFENLGLVSLQMKKPAQAKEYFEKSLRLNRNQ

SEQ ID NO: 337 - protein, 34 aa, Artificial Sequence
  Description of Artificial Sequence: Synthetic segment of CELF38B0
AVAWMNLGISQMNLKKYYEAEKSLKNSLLIRPNS

SEQ ID NO: 338 - protein, 34 aa, Artificial Sequence
  Description of Artificial Sequence: Synthetic segment of JT06030
PETHYNRGLAWERLGNVDQAIADYGRSIALDRYY

SEQ ID NO: 339 - protein, 34 aa, Artificial Sequence
  Description of Artificial Sequence: Synthetic segment of JT06031
YKAYYNRANSYFQLGQYAQAIADYNRVLVLRPDY

SEQ ID NO: 340 - protein, 34 aa, Artificial Sequence
  Description of Artificial Sequence: Synthetic segment of S76422
AEAYYQRGLSHYRLEDWAEAVRDCTEAIRLRGDL

SEQ ID NO: 341 - protein, 34 aa, Artificial Sequence
  Description of Artificial Sequence: Synthetic segment of CC23_YE0
RRIWQVLGECYSKTGNKVEAIKCYKRSIKASQTV

SEQ ID NO: 342 - protein, 34 aa, Artificial Sequence
  Description of Artificial Sequence: Synthetic segment of CELF38B1
AHCLFNLGVLYQRTNRDEMAMSAWKNATRIDPSH

SEQ ID NO: 343 - protein, 34 aa, Artificial Sequence
  Description of Artificial Sequence: Synthetic segment of CC23_YE1
PETCCIIANYYSARQEHEKSIMYFRRALTLDKKT

SEQ ID NO: 344 - protein, 34 aa, Artificial Sequence
  Description of Artificial Sequence: Synthetic segment of CELF38B2
EQALNNLGNLLEKSGDSKTAESLLARAVTLRPSF

SEQ ID NO: 345 - protein, 34 aa, Artificial Sequence
  Description of Artificial Sequence: Synthetic segment of MEU8731
FEAWAALGKLYLAQDDKGRALDAFRRAEALYPQW

SEQ ID NO: 346 - protein, 34 aa, Artificial Sequence
  Description of Artificial Sequence: Synthetic segment of CELF38B3
IQVLLGVAKCWMIQKELDKALESIEKAQELAEGL

SEQ ID NO: 347 - protein, 34 aa, Artificial Sequence
  Description of Artificial Sequence: Synthetic segment of S75615
AEAYKARGKIYWQLGEQAQAIADLEAALALFSDQ

SEQ ID NO: 348 - protein, 34 aa, Artificial Sequence
  Description of Artificial Sequence: Synthetic segment of CELF38B4
VLFHANLGILYQRMSRHKEAESQYRIVLALDSKN

SEQ ID NO: 349 - protein, 34 aa, Artificial Sequence
  Description of Artificial Sequence: Synthetic segment of CC27_YE0
YNAYYGLGTSAMKLGQYEEALLYFEKARSINPVN

SEQ ID NO: 350 - protein, 34 aa, Artificial Sequence
  Description of Artificial Sequence: Synthetic segment of S74806
AEVWLSRGLLLEAMERKEEAIPSYEKALTLEPTL

SEQ ID NO: 351 - protein, 34 aa, Artificial Sequence
  Description of Artificial Sequence: Synthetic segment of CELF38B5
SRVHMQIGSCHAKHSNFTAAENHIKSAIDLNPTS

SEQ ID NO: 352 - protein, 34 aa, Artificial Sequence
  Description of Artificial Sequence: Synthetic segment of CC27_YE1
AYAYTLQGHEHSSNDSSDSAKTCYRKALACDPQH

SEQ ID NO: 353 - protein, 34 aa, Artificial Sequence
  Description of Artificial Sequence: Synthetic segment of CELC56C
VEALRQKGNELFVQKDYKEAIDAYRDALTRLDTL

SEQ ID NO: 354 - protein, 34 aa, Artificial Sequence
  Description of Artificial Sequence: Synthetic segment of F643990
IDLILKVAFTYFKLKKYKHALKYFEKALKLNPNV

SEQ ID NO: 355 - protein, 34 aa, Artificial Sequence
  Description of Artificial Sequence: Synthetic segment of F643991
WKLWKNLGDKAYLWKAYYEALFCYNKALELNQNT

SEQ ID NO: 356 - protein, 34 aa, Artificial Sequence
  Description of Artificial Sequence: Synthetic segment of MTC1_CO
AEFYFRLGESYFAHHQYTFAVSYLEQAIDLFENN

SEQ ID NO: 357 - protein, 34 aa, Artificial Sequence
  Description of Artificial Sequence: Synthetic segment of MM284231_1-255
TEAFYKISTLYYQLGDHELSLSEVRECLKLDQDH

SEQ ID NO: 358 - protein, 34 aa, Artificial Sequence
  Description of Artificial Sequence: Synthetic segment of F643992
TELLCKKGYALLKLYKRDLAIKYFEKASEKDRNN

SEQ ID NO: 359 - protein, 34 aa, Artificial Sequence
  Description of Artificial Sequence: Synthetic segment of KNLC_CA
AKQLNNLALLCQNQGKYEEVEKYYKRALEIYESK

SEQ ID NO: 360 - protein, 34 aa, Artificial Sequence
  Description of Artificial Sequence: Synthetic segment of ATAF0
AQCFMHRASAYRSAGRIAESIADCNKTLALDPSC

SEQ ID NO: 361 - protein, 34 aa, Artificial Sequence
  Description of Artificial Sequence: Synthetic segment of S585440
VKAFYRRALAHKGLKNYQKSLIDLNKVILLDPSI

SEQ ID NO: 362 - protein, 34 aa, Artificial Sequence
  Description of Artificial Sequence: Synthetic segment of S585441
LSIIFNRAACYLKEGNCSGCIQDCNRALELHPFS

SEQ ID NO: 363 - protein, 34 aa, Artificial Sequence
  Description of Artificial Sequence: Synthetic segment of A645120
AVILSNIAKSLYSRGLTNKVIEVYNKAIKIAEES

SEQ ID NO: 364 - protein, 34 aa, Artificial Sequence
  Description of Artificial Sequence: Synthetic segment of A645121
CEAFLNLAKAYERLADFTKALQYGKASLEHPSMD

SEQ ID NO: 365 - protein, 34 aa, Artificial Sequence
  Description of Artificial Sequence: Synthetic segment of AB001
AMSHMNIGICYDELKEYKKASQHLILALEIFEKS

SEQ ID NO: 366 - protein, 34 aa, Artificial Sequence
  Description of Artificial Sequence: Synthetic segment of I49564
PSALTNKGNTVFANGDYEKAAEFYKEALRNDSSC

SEQ ID NO: 367 - protein, 34 aa, Artificial Sequence
  Description of Artificial Sequence: Synthetic segment of OM70_NE
PDIYYHRAQLHFIKGEFAEAAKDYQKSIDLDSDF

SEQ ID NO: 368 - protein, 34 aa, Artificial Sequence
  Description of Artificial Sequence: Synthetic segment of ATU6213
AEAYCNMGVIYKNRGDLEMAITCYERCLAVSPNF

SEQ ID NO: 369 - protein, 34 aa, Artificial Sequence
  Description of Artificial Sequence: Synthetic segment of S75709
PAVWSNRGNSRVSQNKLDEAIADFNQAIELAPEQ

SEQ ID NO: 370 - protein, 34 aa, Artificial Sequence
  Description of Artificial Sequence: Synthetic segment of CELF32A
GRCYGSLGNTYYCLGDYDQSIHFHKLRLELSQQY

SEQ ID NO: 371 - protein, 34 aa, Artificial Sequence
  Description of Artificial Sequence: Synthetic segment of CELT09B0
AEQHNTNGKKCYMNKRYDDAVDHYSKAIKVNPLP

SEQ ID NO: 372 - protein, 34 aa, Artificial Sequence
  Description of Artificial Sequence: Synthetic segment of CELT09B1
VKPLYFLGNVFLQSKKYSEAISCLSKALYHNAVI

SEQ ID NO: 373 - protein, 34 aa, Artificial Sequence
  Description of Artificial Sequence: Synthetic segment of YCF3_OD
SYTLYNIGLIYGNNGNYSQALEYYHQALELNSNL

SEQ ID NO: 374 - protein, 34 aa, Artificial Sequence
  Description of Artificial Sequence: Synthetic segment of YHR7_YE
PPTYYHRGQMYFILQDYKNAKEDFQKAQSLNPEN

SEQ ID NO: 375 - protein, 34 aa, Artificial Sequence
  Description of Artificial Sequence: Synthetic segment of SSN6_YE
PIFWCSIGVLYYQISQYRDALDAYTRAIRLNPYI

SEQ ID NO: 376 - protein, 34 aa, Artificial Sequence
  Description of Artificial Sequence: Synthetic segment of FLBA_CAUCR-226
AVLWNTLGTVLCNIGDAAGSIVFFDESLRLAPDF

SEQ ID NO: 377 - protein, 34 aa, Artificial Sequence
  Description of Artificial Sequence: Synthetic segment of BIMA_EM
YNAWYGLGTVYDKMGKLDFAEQHFRNAAKINPSN

SEQ ID NO: 378 - protein, 34 aa, Artificial Sequence
  Description of Artificial Sequence: Synthetic segment of CUT9_SC0
ASMCYLRGQVYTNLSNFDRAKECYKEALMVDAKC

SEQ ID NO: 379 - protein, 34 aa, Artificial Sequence
  Description of Artificial Sequence: Synthetic segment of CC27_HU
YNAWYGLGMIYYKQEKFSLAEMHFQKALDINPQS

SEQ ID NO: 380 - protein, 34 aa, Artificial Sequence
  Description of Artificial Sequence: Synthetic segment of MMUTY0
AAFLYGLGLVYFYYNAFQWAIRAFQEVLYVDPNF

SEQ ID NO: 381 - protein, 34 aa, Artificial Sequence
  Description of Artificial Sequence: Synthetic segment of KNLC_ST
AKTKNNLAAAYLKQGKYKAAETLYKQVLTRAHER

SEQ ID NO: 382 - protein, 34 aa, Artificial Sequence
  Description of Artificial Sequence: Synthetic segment of S757090
AFAYNNRGNAEGGLGNWTSALEDFQQATAIAPNF

SEQ ID NO: 383 - protein, 34 aa, Artificial Sequence
  Description of Artificial Sequence: Synthetic segment of C48583
VKAYLRRGIAYEGMEKWKLALEDYTKAQSISPGV

SEQ ID NO: 384 - protein, 34 aa, Artificial Sequence
  Description of Artificial Sequence: Synthetic segment of S757091
TDPYLNRGTALEAKGEFKAAIADYNRVLAVNPED

SEQ ID NO: 385 - protein, 34 aa, Artificial Sequence
  Description of Artificial Sequence: Synthetic segment of S759910
GTSLSNIGLAYNNLGEREKALEYYQEALTMSRSV

SEQ ID NO: 386 - protein, 34 aa, Artificial Sequence
  Description of Artificial Sequence: Synthetic segment of S566581
ISYLTNRAAVYLEMGKFEDCIKDCEKAVERGKEL

SEQ ID NO: 387 - protein, 34 aa, Artificial Sequence
  Description of Artificial Sequence: Synthetic segment of S759911
GAILSNIGYVYDGLGELNQAMDYYQQALVLRREI

SEQ ID NO: 388 - protein, 34 aa, Artificial Sequence
  Description of Artificial Sequence: Synthetic segment of S566582
ADEAREKGNELFKQQKYPEATKHYTEAIKRNPKD

SEQ ID NO: 389 - protein, 34 aa, Artificial Sequence
  Description of Artificial Sequence: Synthetic segment of LMU73840
VKGYARKGHAYFWTKQYNRALQAYDEGLKVDPSN

SEQ ID NO: 390 - protein, 34 aa, Artificial Sequence
  Description of Artificial Sequence: Synthetic segment of S759912
VFALNRLGTIYSDFGEKSQALAYYEQAIPLAQQL

SEQ ID NO: 391 - protein, 34 aa, Artificial Sequence
  Description of Artificial Sequence: Synthetic segment of S566583
AQKEKEAGNAAYKKKDFETAIGHYSKALELDDED

SEQ ID NO: 392 - protein, 34 aa, Artificial Sequence
  Description of Artificial Sequence: Synthetic segment of LMU73841
HTSYSNRAAAYIKLGAFNDALKDAEKCIELKPDF

SEQ ID NO: 393 - protein, 34 aa, Artificial Sequence
  Description of Artificial Sequence: Synthetic segment of S759913
GIRLNNIALLYDSVGEKDEALTYYKEALKISQET

SEQ ID NO: 394 - protein, 34 aa, Artificial Sequence
  Description of Artificial Sequence: Synthetic segment of LMU73842
ATELKNKGNEEFSAGRYVEAVNYFSKAIQLDEQN

SEQ ID NO: 395 - protein, 34 aa, Artificial Sequence
  Description of Artificial Sequence: Synthetic segment of S759914
MTTINNLGVAYDNLGESEKALQYYAEALALGKSL

SEQ ID NO: 396 - protein, 34 aa, Artificial Sequence
  Description of Artificial Sequence: Synthetic segment of TPRD_HU
GELMKMKGNEEFSKERFDIAIIYYTRAIEYRPEN

SEQ ID NO: 397 - protein, 34 aa, Artificial Sequence
  Description of Artificial Sequence: Synthetic segment of LMU73843
ALALKEEGNKLYLSKKFEEALTKYQEAQVKDPNN

SEQ ID NO: 398 - protein, 34 aa, Artificial Sequence
  Description of Artificial Sequence: Synthetic segment of S759915
GSVISNIALVLDGLGQKAQALEYYQQALELARLV

SEQ ID NO: 399 - protein, 34 aa, Artificial Sequence
  Description of Artificial Sequence: Synthetic segment of S60905
IEYLYEKAQLYRRLKDKENELKYYNLALSIDENK

SEQ ID NO: 400 - protein, 34 aa, Artificial Sequence
  Description of Artificial Sequence: Synthetic segment of YHBM_HA
ASVYNYLGLYLLLEEDYDGALDAFNTVFELDSGY

SEQ ID NO: 401 - protein, 34 aa, Artificial Sequence
  Description of Artificial Sequence: Synthetic segment of S759916
GATLNNIGSIYNALADRKKAIDFYQQALVLIRQA

SEQ ID NO: 402 - protein, 34 aa, Artificial Sequence
  Description of Artificial Sequence: Synthetic segment of LMU73844
AKQKKDEGNQYFKEDKFPEAVAAYTEAIKRNPAE

SEQ ID NO: 403 - protein, 34 aa, Artificial Sequence
  Description of Artificial Sequence: Synthetic segment of S75633
ASSLNNLGYLAFLQGDLPTALDYYQRALILRQTT

SEQ ID NO: 404 - protein, 34 aa, Artificial Sequence
  Description of Artificial Sequence: Synthetic segment of CET12D8
AMLHAKRANVLLKLKRPVAAIADCDKAISINPDS

SEQ ID NO: 405 - protein, 34 aa, Artificial Sequence
  Description of Artificial Sequence: Synthetic segment of S58544
CAIYTNRALCYLKLCQFEEAKQDCDQALQLADGN

SEQ ID NO: 406 - protein, 34 aa, Artificial Sequence
  Description of Artificial Sequence: Synthetic segment of C485830
AVYYTNRAACHQQTHMYSLMVDDCNAAIEIDPAN

SEQ ID NO: 407 - protein, 34 aa, Artificial Sequence
  Description of Artificial Sequence: Synthetic segment of BSZ9404
WSAYNNLALAYFYSGNVVKAKQTAYEVLSHNEGN

SEQ ID NO: 408 - protein, 34 aa, Artificial Sequence
  Description of Artificial Sequence: Synthetic segment of Y366_HA
AKARVELALSYLQQNNPQLAKINLDKALQHDKNY

SEQ ID NO: 409 - protein, 34 aa, Artificial Sequence
  Description of Artificial Sequence: Synthetic segment of C485831
PEEAKQLGNSFFKDGKYDQAAEFYTRAIELQTEP

SEQ ID NO: 410 - protein, 34 aa, Artificial Sequence
  Description of Artificial Sequence: Synthetic segment of NPRA_BA0
AECHILLGICYRRYGEVDQAIECYSLAHKIAQII

SEQ ID NO: 411 - protein, 34 aa, Artificial Sequence
  Description of Artificial Sequence: Synthetic segment of YC37_PO
AKLYNMLGFIYYKADQKKLAKNFYERAIEVDGNY

SEQ ID NO: 412 - protein, 34 aa, Artificial Sequence
  Description of Artificial Sequence: Synthetic segment of N358_HU
PKAHRFLGLLYELEENTDKAVECYRRSVELNPTQ

SEQ ID NO: 413 - protein, 34 aa, Artificial Sequence
  Description of Artificial Sequence: Synthetic segment of S42210
TDVLRSAARFYYKTHDKDRAIQLLSQALELLPNN

SEQ ID NO: 414 - protein, 34 aa, Artificial Sequence
  Description of Artificial Sequence: Synthetic segment of CC27_YE
PETWCCIGNLLSLQKDHDAAIKAFEKATQLDPNF

SEQ ID NO: 415 - protein, 34 aa, Artificial Sequence
  Description of Artificial Sequence: Synthetic segment of HIBN_XE0
AQAHQKLGEVCIESENYSQAVEDFLACLNIQKEH

SEQ ID NO: 416 - protein, 34 aa, Artificial Sequence
  Description of Artificial Sequence: Synthetic segment of STI1_YE0
ARGYSNRAAALAKLMSFPEAIADCNKAIEKDPNF

SEQ ID NO: 417 - protein, 34 aa, Artificial Sequence
  Description of Artificial Sequence: Synthetic segment of STI1_YE1
ADEYKQQGNAAFTAKDYDKAIELFTKAIEVSETP

SEQ ID NO: 418 - protein, 34 aa, Artificial Sequence
  Description of Artificial Sequence: Synthetic segment of CELF32A0
AQMAYSLANALYIGKEVQKAITYFQRHLKIARSL

SEQ ID NO: 419 - protein, 34 aa, Artificial Sequence
  Description of Artificial Sequence: Synthetic segment of STI1_YE2
SKSFARIGNAYHKLGDLKKTIEYYQKSLTEHRTA

SEQ ID NO: 420 - protein, 34 aa, Artificial Sequence
  Description of Artificial Sequence: Synthetic segment of LACALS
ISIYQRIGDSYAQLGNFENAISFLEKSLEFDEKP

SEQ ID NO: 421 - protein, 34 aa, Artificial Sequence
  Description of Artificial Sequence: Synthetic segment of CELR05F
SKAWGRMGLAYSCQNRYEHAAEAYKKALELEPNQ

SEQ ID NO: 422 - protein, 34 aa, Artificial Sequence
  Description of Artificial Sequence: Synthetic segment of G025400
AKASGNLGNTLKVLGNFDEAIVCCQRHLDISREL

SEQ ID NO: 423 - protein, 34 aa, Artificial Sequence
  Description of Artificial Sequence: Synthetic segment of G025401
RRAYSNLGNAYIFLGEFETASEYYKKTLLLARQL

SEQ ID NO: 424 - protein, 34 aa, Artificial Sequence
  Description of Artificial Sequence: Synthetic segment of H64467
PLLYLYKGIILNKLGKYNEAIKYFDKVLEINPNI

SEQ ID NO: 425 - protein, 34 aa, Artificial Sequence
  Description of Artificial Sequence: Synthetic segment of G025402
SAIYSQLGNAYFYLHDYAKALEYHHHDLTLARTI

SEQ ID NO: 426 - protein, 34 aa, Artificial Sequence
  Description of Artificial Sequence: Synthetic segment of G025403
GRACWSLGNAYTALGNHDQAMHFAEKHLEISREV

SEQ ID NO: 427 - protein, 34 aa, Artificial Sequence
  Description of Artificial Sequence: Synthetic segment of PTSR_HU0
YLLWNKLGATLANGNQSEEAVAAYRRALELQPGY

SEQ ID NO: 428 - protein, 34 aa, Artificial Sequence
  Description of Artificial Sequence: Synthetic segment of G025404
GRAFGNLGNTHYLLGNFRDAVIAHEQRLLIAKEF

SEQ ID NO: 429 - protein, 34 aa, Artificial Sequence
  Description of Artificial Sequence: Synthetic segment of PTSR_HU1
IRSRYNLGISCINLGAHREAVEHFLEALNMQRKS

SEQ ID NO: 430 - protein, 34 aa, Artificial Sequence
  Description of Artificial Sequence: Synthetic segment of G025405
TKQQIEKGLQLYQANETGKALEIWQQVVERSTEL

SEQ ID NO: 431 - protein, 34 aa, Artificial Sequence
  Description of Artificial Sequence: Synthetic segment of YCA1_PL0
PKGYIRKGCAEHGLRQLSNAEKTYLEGLKIDPNN

SEQ ID NO: 432 - protein, 34 aa, Artificial Sequence
  Description of Artificial Sequence: Synthetic segment of PQ01800
PETWLNRGLAYYRQGQSQAAIADFDQLLQQSPTD

SEQ ID NO: 433 - protein, 34 aa, Artificial Sequence
  Description of Artificial Sequence: Synthetic segment of CEC34C61
VRARYNLGISCMQLSSYDEALKHFLSALELQKGG

SEQ ID NO: 434 - protein, 34 aa, Artificial Sequence
  Description of Artificial Sequence: Synthetic segment of CEC34C62
PDLQNALGVLYNLNRNFARAVDSLKLAISKNPTD

SEQ ID NO: 435 - protein, 34 aa, Artificial Sequence
  Description of Artificial Sequence: Synthetic segment of SSD900_122-109
ADAYYNRGYAKHVLGQYQAAITDYNQAISLNPEF

SEQ ID NO: 436 - protein, 34 aa, Artificial Sequence
  Description of Artificial Sequence: Synthetic segment of STI1_YE
SKGYNRLGAAHLGLGDLDEAESNYKKALELDASN

SEQ ID NO: 437 - protein, 34 aa, Artificial Sequence
  Description of Artificial Sequence: Synthetic segment of YCV0_YE
PVGYSNKAMALIKLGEYTQAIQMCQQGLRYTSTA

SEQ ID NO: 438 - protein, 34 aa, Artificial Sequence
  Description of Artificial Sequence: Synthetic segment of HSAB2370_1-631
FNCWESLGEAYLSRGGYTTALKSFTKASELNPES

SEQ ID NO: 439 - protein, 34 aa, Artificial Sequence
  Description of Artificial Sequence: Synthetic segment of S75648
ADAYNLRGVAYMVIEQYTDALADFDQAIALNPKD

SEQ ID NO: 440 - protein, 34 aa, Artificial Sequence
  Description of Artificial Sequence: Synthetic segment of CELT19A0
PLFHYVQGRMKLLLHDVDKAIQHLKDAMDKDPNN

SEQ ID NO: 441 - protein, 34 aa, Artificial Sequence
  Description of Artificial Sequence: Synthetic segment of CELT25F0
FEGNYNLGLVSFTQGKYHECRELIEKALAAFPEH

SEQ ID NO: 442 - protein, 34 aa, Artificial Sequence
  Description of Artificial Sequence: Synthetic segment of CEF10B5
HPMLNNIGHIARRQGRLNEAIMFYQKAIRMEPKF

SEQ ID NO: 443 - protein, 34 aa, Artificial Sequence
  Description of Artificial Sequence: Synthetic segment of CELT25F1
VTMLTGMARVQEALGEYDESVKLYKRVLDAESNN

SEQ ID NO: 444 - protein, 34 aa, Artificial Sequence
  Description of Artificial Sequence: Synthetic segment of BSAB617_17-292
VQAVFSLTHIYCKEGKYDKAVEAYDRGIKSAAEW

SEQ ID NO: 445 - protein, 34 aa, Artificial Sequence
  Description of Artificial Sequence: Synthetic segment of CEM720
ATMLNVLAIVYRNQENFKDAAIYLEKALSIRVQC

SEQ ID NO: 446 - protein, 34 aa, Artificial Sequence
  Description of Artificial Sequence: Synthetic segment of YCV0_YE0
FEKQKEQGNSLFKQGLYREAVHCYDQLITAQPQN

SEQ ID NO: 447 - protein, 34 aa, Artificial Sequence
  Description of Artificial Sequence: Synthetic segment of YCV0_YE1
AMSQYHMAVAYRLLGRLGSAMECCEESMKIALQH

SEQ ID NO: 448 - protein, 34 aa, Artificial Sequence
  Description of Artificial Sequence: Synthetic segment of CELC55B0
YQAIYRRATTYLAMGRGKAAIVDLERVLELKPDF

SEQ ID NO: 449 - protein, 34 aa, Artificial Sequence
  Description of Artificial Sequence: Synthetic segment of CELC55B1
YGARIQRGNILLKQGELEAAEADFNIVLNHDSSN

SEQ ID NO: 450 - protein, 34 aa, Artificial Sequence
  Description of Artificial Sequence: Synthetic segment of HSU46570
AKLYCNRGTVNSKLRKLDDAIEDCTNAVKLDDTY

SEQ ID NO: 451 - protein, 34 aa, Artificial Sequence
  Description of Artificial Sequence: Synthetic segment of HSU46571
SILFSNRAAARMKQDKKEMAINDCSKAIQLNPSY

SEQ ID NO: 452 - protein, 34 aa, Artificial Sequence
  Description of Artificial Sequence: Synthetic segment of BSU5504
TKGLLNLGNCFNKQDDVAKATVYYQRALELGEKI

SEQ ID NO: 453 - protein, 34 aa, Artificial Sequence
  Description of Artificial Sequence: Synthetic segment of HSU46572
ADALYVRGLCLYYEDCIEKAVQFFVQALRMAPDH

SEQ ID NO: 454 - protein, 34 aa, Artificial Sequence
  Description of Artificial Sequence: Synthetic segment of HSU46573
IRAILRRAELYEKTDKLDEALEDYKSILEKDPSI

SEQ ID NO: 455 - protein, 34 aa, Artificial Sequence
  Description of Artificial Sequence: Synthetic segment of HSU46574
IKAYLRRAQCYMDTEQYEEAVRDYEKVYQTEKTK

SEQ ID NO: 456 - protein, 34 aa, Artificial Sequence
  Description of Artificial Sequence: Synthetic segment of LJGLN12
ASACNNLAEFYRIRKEFDKAEPLYLEAINILEES

SEQ ID NO: 457 - protein, 34 aa, Artificial Sequence
  Description of Artificial Sequence: Synthetic segment of HSU46575
LKAKKEDGNKAFKEGNYKLAYELYTEALGIDPNN

SEQ ID NO: 458 - protein, 34 aa, Artificial Sequence
  Description of Artificial Sequence: Synthetic segment of D504537
GRAYYNLGLCYYNQDLLDPAIDYFEKAVSTFESS

SEQ ID NO: 459 - protein, 34 aa, Artificial Sequence
  Description of Artificial Sequence: Synthetic segment of MMUTY
ADTWCSIGVLYQQQNQPMDALQAYICAVQLDHGH

SEQ ID NO: 460 - protein, 34 aa, Artificial Sequence
  Description of Artificial Sequence: Synthetic segment of CELD2020
SAAWTDLGELYEKNAQYQDALECFKNAMLNNPVA

SEQ ID NO: 461 - protein, 34 aa, Artificial Sequence
  Description of Artificial Sequence: Synthetic segment of HSU46576
STRLKEEGNEQFKKGDYIEAESSYSRALEMCPSC

SEQ ID NO: 462 - protein, 34 aa, Artificial Sequence
  Description of Artificial Sequence: Synthetic segment of YB05_YE
ESLYANRAACELELKNYRRCIEDCSKALTINPKN

SEQ ID NO: 463 - protein, 34 aa, Artificial Sequence
  Description of Artificial Sequence: Synthetic segment of HUMFKBP0
VKCLNNLAASQLKLDHYRAALRSCSLVLEHQPDN

SEQ ID NO: 464 - protein, 34 aa, Artificial Sequence
  Description of Artificial Sequence: Synthetic segment of HSU46577
ASYYGNRAATLMMLGRFREALGDAQQSVRLDDSF

SEQ ID NO: 465 - protein, 34 aa, Artificial Sequence
  Description of Artificial Sequence: Synthetic segment of CEM72
AKQLTNLGIVTQQLEKYEETENYFKQALSIYNRA

SEQ ID NO: 466 - protein, 34 aa, Artificial Sequence
  Description of Artificial Sequence: Synthetic segment of S75578
SYILYNMALIHASNGDHEKALGLYQEAIELNPKM

SEQ ID NO: 467 - protein, 34 aa, Artificial Sequence
  Description of Artificial Sequence: Synthetic segment of PSEPILF0
RDAYIQLGLGYLQRGNTEQAKVPLRKALEIDPSS

SEQ ID NO: 468 - protein, 34 aa, Artificial Sequence
  Description of Artificial Sequence: Synthetic segment of S450640
AKSCANLGNIFKMKGAYNDALTFTFKQLDFAEEL

SEQ ID NO: 469 - protein, 34 aa, Artificial Sequence
  Description of Artificial Sequence: Synthetic segment of BBCDG5
ARFFNLIGLEFFKLGQYGPAIEYFAKNLEINPNN

SEQ ID NO: 470 - protein, 34 aa, Artificial Sequence
  Description of Artificial Sequence: Synthetic segment of I40554
AKALLNLGDSYKNMGDQDRALYFLIKAVDQAKES

SEQ ID NO: 471 - protein, 34 aa, Artificial Sequence
  Description of Artificial Sequence: Synthetic segment of ACU89981
SRAFHRKGNAYMKMEKYAEAIDSYNRALTEHRNP

SEQ ID NO: 472 - protein, 34 aa, Artificial Sequence
  Description of Artificial Sequence: Synthetic segment of HSU20361
IKIMQNIGVTFIQAGQYSDAINSYEHIMSMAPNL

SEQ ID NO: 473 - protein, 34 aa, Artificial Sequence
  Description of Artificial Sequence: Synthetic segment of S668420
EDVQLNLAHCYLEMREYGKAIENYELVLKKFDNE

SEQ ID NO: 474 - protein, 34 aa, Artificial Sequence
  Description of Artificial Sequence: Synthetic segment of HSU20362
GQSWYFLGRCYSCIGKVQDAFVSYRQSIDKSEAS

SEQ ID NO: 475 - protein, 34 aa, Artificial Sequence
  Description of Artificial Sequence: Synthetic segment of ACU89983
ALEEKNKGNAAMSAGDFKAAVEHYTNAIQHDPQN

SEQ ID NO: 476 - protein, 34 aa, Artificial Sequence
  Description of Artificial Sequence: Synthetic segment of S748530
WPALNNIGLIEYEQGKIDTALKRWQEVIKIDSEQ

SEQ ID NO: 477 - protein, 34 aa, Artificial Sequence
  Description of Artificial Sequence: Synthetic segment of HSU20363
CRVCCSLGSFYAQVKDYEKALFFPCKAAELVNNY

SEQ ID NO: 478 - protein, 34 aa, Artificial Sequence
  Description of Artificial Sequence: Synthetic segment of ACU89984
SKGYSRKGAALCYLGRYADAKAAYAAGLEVEPTN

SEQ ID NO: 479 - protein, 34 aa, Artificial Sequence
  Description of Artificial Sequence: Synthetic segment of S748531
AGIKFTLGNAYFQKGQYDQAVEVLLAGLAQRPDT

SEQ ID NO: 480 - protein, 34 aa, Artificial Sequence
  Description of Artificial Sequence: Synthetic segment of ACU89985
SQQEKEKGNDCFRNAQYPDAIKHYTEAIRRNPTD

SEQ ID NO: 481 - protein, 34 aa, Artificial Sequence
  Description of Artificial Sequence: Synthetic segment of D63875
AEVRLGMGHCFVKLNKLEKARLAFSRALELNSKC

SEQ ID NO: 482 - protein, 34 aa, Artificial Sequence
  Description of Artificial Sequence: Synthetic segment of ACU89986
MTYLTNLAAVYMEQKNYEECVNTCTEAIEVGRRV

SEQ ID NO: 483 - protein, 34 aa, Artificial Sequence
  Description of Artificial Sequence: Synthetic segment of YCOA_SY
TVALTALGLAARAIGNYPEAIAAYQQALQLDPND

SEQ ID NO: 484 - protein, 34 aa, Artificial Sequence
  Description of Artificial Sequence: Synthetic segment of D644170
PVAYALLGQLYELLGNFDNALECYEKSLGIEEKF

SEQ ID NO: 485 - protein, 34 aa, Artificial Sequence
  Description of Artificial Sequence: Synthetic segment of YCIM_HA
VRASLLLANLAMLDGQYQQAVKILENVLEQNPDY

SEQ ID NO: 486 - protein, 34 aa, Artificial Sequence
  Description of Artificial Sequence: Synthetic segment of D644171
IPAYIIKANMLRKLGRYEEALACVNKVLELKEND

SEQ ID NO: 487 - protein, 34 aa, Artificial Sequence
  Description of Artificial Sequence: Synthetic segment of YLU28151
AEAWGRLGACQAQNEKEDPAIRALERCIKLEPGN

SEQ ID NO: 488 - protein, 34 aa, Artificial Sequence
  Description of Artificial Sequence: Synthetic segment of S74853
PAALFDLGNAYLKLVKYPDAVTAYQKALKAEEQF

SEQ ID NO: 489 - protein, 34 aa, Artificial Sequence
  Description of Artificial Sequence: Synthetic segment of HGV2_HA
AETYYNLGLAYSFEKRYDNALEHYQSALDVLEAR

SEQ ID NO: 490 - protein, 34 aa, Artificial Sequence
  Description of Artificial Sequence: Synthetic segment of CELR05F0
PVYFCNRAAAYCRLEQYDLAIQDCRTALALDPSY

SEQ ID NO: 491 - protein, 34 aa, Artificial Sequence
  Description of Artificial Sequence: Synthetic segment of YC37_CY
ALIYNSLGYICSAQEQYELAIEYYKKALFYIPDF

SEQ ID NO: 492 - protein, 34 aa, Artificial Sequence
  Description of Artificial Sequence: Synthetic segment of NCF2_HU
AVAYFQRGMLYYQTEKYDLAIKDLKEALIQLRGN

SEQ ID NO: 493 - protein, 34 aa, Artificial Sequence
  Description of Artificial Sequence: Synthetic segment of HUMFKBP
IKALFRKGKVLAQQGEYSEAIPILRAALKLEPSN

SEQ ID NO: 494 - protein, 34 aa, Artificial Sequence
  Description of Artificial Sequence: Synthetic segment of JC47510
VAVRLNLGLTYLKLCKPDKCIEFCRKVLDVFGNN

SEQ ID NO: 495 - protein, 34 aa, Artificial Sequence
  Description of Artificial Sequence: Synthetic segment of I40567
AKALLNMGNSYNQMGSLFSAVPYYHKAIKAAKIS

SEQ ID NO: 496 - protein, 34 aa, Artificial Sequence
  Description of Artificial Sequence: Synthetic segment of CEZK856
AIAYQQIATVYEQLGDHQKALQFGLLASHLDPKT

SEQ ID NO: 497 - protein, 34 aa, Artificial Sequence
  Description of Artificial Sequence: Synthetic segment of S756480
PAIYFNRANVHGVLNNYQGAIDDCSQGILLDPQD

SEQ ID NO: 498 - protein, 34 aa, Artificial Sequence
  Description of Artificial Sequence: Synthetic segment of S756481
EEAHYFRGLAYAMVNNYERALADLNRTIRLNPYN

SEQ ID NO: 499 - protein, 34 aa, Artificial Sequence
  Description of Artificial Sequence: Synthetic segment of LEPLIPL
WGAKANLATYYFSAGDFEKSIKLYEEAMKLKDAD

SEQ ID NO: 500 - protein, 34 aa, Artificial Sequence
  Description of Artificial Sequence: Synthetic segment of S756482
VDLLICRGQAQLGLEQPRQAIPDFDRAIELDPRS

SEQ ID NO: 501 - protein, 34 aa, Artificial Sequence
  Description of Artificial Sequence: Synthetic segment of CUT9_SC
AATWANLGHAYRKLKMYDAAIDALNQGLLLSTND

SEQ ID NO: 502 - protein, 34 aa, Artificial Sequence
  Description of Artificial Sequence: Synthetic segment of PS43_TO0
AHVLLNIAKCWMTEKKLDKTLGVVQKAEELADAV

SEQ ID NO: 503 - protein, 34 aa, Artificial Sequence
  Description of Artificial Sequence: Synthetic segment of RNU76551
ADSLNNLANIKREQGNIEEAVRLYRKALEVFPEF

SEQ ID NO: 504 - protein, 34 aa, Artificial Sequence
  Description of Artificial Sequence: Synthetic segment of S66842
PDPRIGIGLCFWQLKDSKMAIKSWQRALQLNPKN

SEQ ID NO: 505 - protein, 34 aa, Artificial Sequence
  Description of Artificial Sequence: Synthetic segment of HSU58970
SVLYSNRAACHWKNGNCRDCIKDCTSALALVPFS

SEQ ID NO: 506 - protein, 34 aa, Artificial Sequence
  Description of Artificial Sequence: Synthetic segment of RNU76552
PDAYCNLANALKEKGSVAEAEDCYNTALRLCPTH

SEQ ID NO: 507 - protein, 34 aa, Artificial Sequence
  Description of Artificial Sequence: Synthetic segment of JC4751
EKALFRMGQAHLLRNDHDEALVYFKKIVAKNPNN

SEQ ID NO: 508 - protein, 34 aa, Artificial Sequence
  Description of Artificial Sequence: Synthetic segment of HSU58971
IKPLLRRASAYEALEKYPMAYVDYKTVLQIDDNV

SEQ ID NO: 509 - protein, 34 aa, Artificial Sequence
  Description of Artificial Sequence: Synthetic segment of RNU76553
YCVRSDLGNLLKALGRLEEAKACYLKAIETQPNF

SEQ ID NO: 510 - protein, 34 aa, Artificial Sequence
  Description of Artificial Sequence: Synthetic segment of HSU58972
VKAFYRRAQAHKALKDYKSSFADISNLLQIEPRN

SEQ ID NO: 511 - protein, 34 aa, Artificial Sequence
  Description of Artificial Sequence: Synthetic segment of RNU76554
LDAYINLGNVLKEARIFDRAVAAYLRALSLSPNH

SEQ ID NO: 512 - protein, 34 aa, Artificial Sequence
  Description of Artificial Sequence: Synthetic segment of YQGP_BA
HASYYNLALLYAEKNELAQAEKAIQTAVKLKPKE

SEQ ID NO: 513 - protein, 34 aa, Artificial Sequence
  Description of Artificial Sequence: Synthetic segment of D907664
ARVSIMMGRVFMAKGEYAKAVESLQRVISQDREL

SEQ ID NO: 514 - protein, 34 aa, Artificial Sequence
  Description of Artificial Sequence: Synthetic segment of AB0010
GKYYKEIAELYELEQNFEQAIIYFEKAADIYQSE

SEQ ID NO: 515 - protein, 34 aa, Artificial Sequence
  Description of Artificial Sequence: Synthetic segment of KNLC_HU
AATLNNLAVLYGKRGKYKEAEPLCKRALEIREKV

SEQ ID NO: 516 - protein, 34 aa, Artificial Sequence
  Description of Artificial Sequence: Synthetic segment of S756010
FWSWYRQADCFRRWGHYAEALQCYKKSLEIRPND

SEQ ID NO: 517 - protein, 34 aa, Artificial Sequence
  Description of Artificial Sequence: Synthetic segment of G02058
VQSLSALGFVYKLEGEKRQAAEYYEKAQKIDPEN

SEQ ID NO: 518 - protein, 34 aa, Artificial Sequence
  Description of Artificial Sequence: Synthetic segment of YQCH_BA0
PQAYHDLALIYFKQGKKGQAMDCFRKGIRSAVDF

SEQ ID NO: 519 - protein, 34 aa, Artificial Sequence
  Description of Artificial Sequence: Synthetic segment of S756011
YWAWYKRGITLEHLGRYRDAAESYDNACQIQPEN

SEQ ID NO: 520 - protein, 34 aa, Artificial Sequence
  Description of Artificial Sequence: Synthetic segment of S756012
YWATYRLGESYRLSGQYEAAIASFRQTLTIRQDD

SEQ ID NO: 521 - protein, 34 aa, Artificial Sequence
  Description of Artificial Sequence: Synthetic segment of S760710
VIALNNLANVYEKKQMVNKALETYQETLAIEPNN

SEQ ID NO: 522 - protein, 34 aa, Artificial Sequence
  Description of Artificial Sequence: Synthetic segment of CC23_YE
TNAWTLMGHEFVELSNSHAAIECYRRAVDICPRD

SEQ ID NO: 523 - protein, 34 aa, Artificial Sequence
  Description of Artificial Sequence: Synthetic segment of S756013
YWAWFRQGELWQQIYRYGRAIACYHRALDVEVDD

SEQ ID NO: 524 - protein, 34 aa, Artificial Sequence
  Description of Artificial Sequence: Synthetic segment of S760711
AQEYYQLGSIYLDKKLYSQSINLFQKALKMAEQV

SEQ ID NO: 525 - protein, 34 aa, Artificial Sequence
  Description of Artificial Sequence: Synthetic segment of CEC34C6
ARAWCKLGLAHAENEKDQLAMQAFQKCLQIDAGN

SEQ ID NO: 526 - protein, 34 aa, Artificial Sequence
  Description of Artificial Sequence: Synthetic segment of PTSR_PI0
VDAWLKLGEVQTQNEKESDGIAALEKCLELDPTN

SEQ ID NO: 527 - protein, 34 aa, Artificial Sequence
  Description of Artificial Sequence: Synthetic segment of PTSR_PI1
VRARYNLGVSFINMGRYKEAVEHLLTGISLHEVE

SEQ ID NO: 528 - protein, 34 aa, Artificial Sequence
  Description of Artificial Sequence: Synthetic segment of INI6_HU
LESLSLLGFVYKLEGNMNEALEYYERALRLAADF

SEQ ID NO: 529 - protein, 34 aa, Artificial Sequence
  Description of Artificial Sequence: Synthetic segment of S75202
AELFGSMGYLYARQGQFAEASRSFQQALRVNPNN

SEQ ID NO: 530 - protein, 34 aa, Artificial Sequence
  Description of Artificial Sequence: Synthetic segment of YO91_CA
ARAHRSLGHLLLMDKKFEEAYKHLRRSLELQPIQ

SEQ ID NO: 531 - protein, 34 aa, Artificial Sequence
  Description of Artificial Sequence: Synthetic segment of CC16_YE0
ISIQLNLGHTYRKLNENEIAIKCFRCVLEKNDKN

SEQ ID NO: 532 - protein, 34 aa, Artificial Sequence
  Description of Artificial Sequence: Synthetic segment of CC16_YE1
PLVLNEMGVMYFKKNEFVKAKKYLKKALEVVKDL

SEQ ID NO: 533 - protein, 34 aa, Artificial Sequence
  Description of Artificial Sequence: Synthetic segment of CC16_YE2
SSLCFLRGKIYFAQNNFNKARDAFREAILVDIKN

SEQ ID NO: 534 - protein, 34 aa, Artificial Sequence
  Description of Artificial Sequence: Synthetic segment of CC16_YE3
AITWFSVATYYMSLDRISEAQKYYSKSSILDPSF

SEQ ID NO: 535 - protein, 34 aa, Artificial Sequence
  Description of Artificial Sequence: Synthetic segment of ACSC_AC
ADSLGGMGLVSMRQGDTAEARRYFEEAMAADPKT

SEQ ID NO: 536 - protein, 34 aa, Artificial Sequence
  Description of Artificial Sequence: Synthetic segment of HSU5251
TDVLRSAAKFYRRKGDLDKAIELFQRVLESTPNN

SEQ ID NO: 537 - protein, 34 aa, Artificial Sequence
  Description of Artificial Sequence: Synthetic segment of CC16_YE4
TEGYLNLARSNEKLCEFQKTISYCKTCLNMQGTT

SEQ ID NO: 538 - protein, 34 aa, Artificial Sequence
  Description of Artificial Sequence: Synthetic segment of NCU89985_1-41
AIAFKNEGNKAFAAHDWPKAIEFYDKAIELNDKE

SEQ ID NO: 539 - protein, 34 aa, Artificial Sequence
  Description of Artificial Sequence: Synthetic segment of CC16_YE5
AAAWLGFAHTYALEGEQDQALTAYSTASRFFPGM

SEQ ID NO: 540 - protein, 34 aa, Artificial Sequence
  Description of Artificial Sequence: Synthetic segment of CYP6_YE
AKALYRRGLAYYHVNDTDMALNDLEMATTFQPND

SEQ ID NO: 541 - protein, 34 aa, Artificial Sequence
  Description of Artificial Sequence: Synthetic segment of D638750
VDCYLRLGAMARDKGNFYEASDWFKEALQINQDH

SEQ ID NO: 542 - protein, 34 aa, Artificial Sequence
  Description of Artificial Sequence: Synthetic segment of S75685
AQAHCLLGMAYLKNNMMTMAKVHIGSAVKLDPND

SEQ ID NO: 543 - protein, 34 aa, Artificial Sequence
  Description of Artificial Sequence: Synthetic segment of S76576
PQLFYGWGLLETSKGNYQSALNHYDQALALDPEF

SEQ ID NO: 544 - protein, 34 aa, Artificial Sequence
  Description of Artificial Sequence: Synthetic segment of D638751
VLPFFGLGQMYIYRGDKENASQCFEKVLKAYPNN

SEQ ID NO: 545 - protein, 34 aa, Artificial Sequence
  Description of Artificial Sequence: Synthetic segment of D638752
IPALLGKACISFNKKDYRGALAYYKKALRTNPGC

SEQ ID NO: 546 - protein, 34 aa, Artificial Sequence
  Description of Artificial Sequence: Synthetic segment of H644670
AIAWAEKGEILYREGKLKKSLECFDNALKINPKD

SEQ ID NO: 547 - protein, 34 aa, Artificial Sequence
  Description of Artificial Sequence: Synthetic segment of RLU3940
GRAYRELGFVALYRRRFDESLEYFQQAQDLNPND

SEQ ID NO: 548 - protein, 34 aa, Artificial Sequence
  Description of Artificial Sequence: Synthetic segment of H644671
PDVYVRKARILRTLGENDKALEYFDKALKLKPKY

SEQ ID NO: 549 - protein, 34 aa, Artificial Sequence
  Description of Artificial Sequence: Synthetic segment of MMU1695
LAAFLNLAMCYLKLREYNKAVECCDKALGLDSAN

SEQ ID NO: 550 - protein, 34 aa, Artificial Sequence
  Description of Artificial Sequence: Synthetic segment of D638753
AESCYQLARSFHVQEDYDQAFQYYYQATQFASSS

SEQ ID NO: 551 - protein, 34 aa, Artificial Sequence
  Description of Artificial Sequence: Synthetic segment of I495640
GRLKVNMGNIYLKQRNYSKAIKFYRMALDQIPSV

SEQ ID NO: 552 - protein, 34 aa, Artificial Sequence
  Description of Artificial Sequence: Synthetic segment of OM70_NE0
ALAYNLRGTFHCLMGKHEEALADLSKSIELDPAM

SEQ ID NO: 553 - protein, 34 aa, Artificial Sequence
  Description of Artificial Sequence: Synthetic segment of H644672
CQSLLYKGEILFKLGRYGEALKCLKKVFERNNKD

SEQ ID NO: 554 - protein, 34 aa, Artificial Sequence
  Description of Artificial Sequence: Synthetic segment of D638754
SDVWLNLAHIYVEQKQYISAVQMYENCLRKFYKH

SEQ ID NO: 555 - protein, 34 aa, Artificial Sequence
  Description of Artificial Sequence: Synthetic segment of I495641
AQVLCQIANIYELMEDPNQAIEWLMQLISVVPTD

SEQ ID NO: 556 - protein, 34 aa, Artificial Sequence
  Description of Artificial Sequence: Synthetic segment of H644673
IRALMYIIQILIYLGRLNQALEYTKKALKLNPDD

SEQ ID NO: 557 - protein, 34 aa, Artificial Sequence
  Description of Artificial Sequence: Synthetic segment of OM70_NE1
TQSYIKRASMNLELGHPDKAEEDFNKAIEQNAED

SEQ ID NO: 558 - protein, 34 aa, Artificial Sequence
  Description of Artificial Sequence: Synthetic segment of D638755
VTTSYNLARLYEAMCEFHEAEKLYKNILREHPNY

SEQ ID NO: 559 - protein, 34 aa, Artificial Sequence
  Description of Artificial Sequence: Synthetic segment of CELF38B
AKIHYNLGKVLGDNGLTKDAEKNYWNAIKLDPSY

SEQ ID NO: 560 - protein, 34 aa, Artificial Sequence
  Description of Artificial Sequence: Synthetic segment of JT0603
IPPYINRGNLYSQQQDHHTAIQDFTQAITYDPNR

SEQ ID NO: 561 - protein, 34 aa, Artificial Sequence
  Description of Artificial Sequence: Synthetic segment of YHBM_EC0
AQLLYERGVLYDSLGLRALARNDFSQALAIRPDM

SEQ ID NO: 562 - protein, 34 aa, Artificial Sequence
  Description of Artificial Sequence: Synthetic segment of OM70_NE2
AAKLKELGNKAYGSKDFNKAIDLYSKAIICKPDP

SEQ ID NO: 563 - protein, 34 aa, Artificial Sequence
  Description of Artificial Sequence: Synthetic segment of I495642
SQALSKLGELYDSEGDKSQAFQYYYESYRYFPSN

SEQ ID NO: 564 - protein, 34 aa, Artificial Sequence
  Description of Artificial Sequence: Synthetic segment of OM70_NE3
PVYYSNRAACHNALAQWEQVVADTTAALKLDPHY

SEQ ID NO: 565 - protein, 34 aa, Artificial Sequence
  Description of Artificial Sequence: Synthetic segment of PQ0180
YRAYYNRGLAYLDLAQPEQAIADFQQALERLPAT

SEQ ID NO: 566 - protein, 34 aa, Artificial Sequence
  Description of Artificial Sequence: Synthetic segment of 2408032-184
ARAFGRLGRAKLSLGDAAAAADAYKKGLDFDPNN

SEQ ID NO: 567 - protein, 34 aa, Artificial Sequence
  Description of Artificial Sequence: Synthetic segment of HSU5897
SATYSNRALCYLVLKQYTEAVKDCTEALKLDGKN

SEQ ID NO: 568 - protein, 34 aa, Artificial Sequence
  Description of Artificial Sequence: Synthetic segment of TAFKBP7
ISIKLNNAACKLKLKDYKEAEKICSKVLELESTN

SEQ ID NO: 569 - protein, 34 aa, Artificial Sequence
  Description of Artificial Sequence: Synthetic segment of YC37_CY0
ILARINLARIFELKNLKTEAINMYQEVLIFDPKN

SEQ ID NO: 570 - protein, 34 aa, Artificial Sequence
  Description of Artificial Sequence: Synthetic segment of YC37_PO0
IVALNNLAKIYEDTKNILKAEALYDKVLNIAKSN

SEQ ID NO: 571 - protein, 34 aa, Artificial Sequence
  Description of Artificial Sequence: Synthetic segment of D643710
RDAWFNKALALRILGRYEEARECFFRGLAVEKHL

SEQ ID NO: 572 - protein, 34 aa, Artificial Sequence
  Description of Artificial Sequence: Synthetic segment of ATAC01
SSVHASLGKIYNQLKQYDKAVLHFGIALDLSPSP

SEQ ID NO: 573 - protein, 34 aa, Artificial Sequence
  Description of Artificial Sequence: Synthetic segment of HSU2036
TEALYNIGLTYEKLNRLDEALDCFLKLHAILRNS

SEQ ID NO: 574 - protein, 34 aa, Artificial Sequence
  Description of Artificial Sequence: Synthetic segment of CELK04G1
AVAWSNLGCVFNSQGEIWLAIHHFEKAVTLDPNF

SEQ ID NO: 575 - protein, 34 aa, Artificial Sequence
  Description of Artificial Sequence: Synthetic segment of ACU8998
HVLYSNRAACYMKLGRVPMAVKDCDKAIELSPTF

SEQ ID NO: 576 - protein, 34 aa, Artificial Sequence
  Description of Artificial Sequence: Synthetic segment of ATAC02
TYAHTLCGHEFAALEEFEDAERCYRKALGIDTRH

SEQ ID NO: 577 - protein, 34 aa, Artificial Sequence
  Description of Artificial Sequence: Synthetic segment of YHE3_PS
PAILDSMGWINYRQGKLADAERYLRQALQRYPDH

SEQ ID NO: 578 - protein, 34 aa, Artificial Sequence
  Description of Artificial Sequence: Synthetic segment of CELK04G2
AVVHGNLACVYYEQGLIDLAIDTYKKAIDLQPHF

SEQ ID NO: 579 - protein, 34 aa, Artificial Sequence
  Description of Artificial Sequence: Synthetic segment of SC72_YE
PDVFVRKADCLLKLRQWEEARATCERGLALAPED

SEQ ID NO: 580 - protein, 34 aa, Artificial Sequence
  Description of Artificial Sequence: Synthetic segment of CELK04G3
AAAHSNLASILQQQGKLNDAILHYKEAIRIAPTF

SEQ ID NO: 581 - protein, 34 aa, Artificial Sequence
  Description of Artificial Sequence: Synthetic segment of CELK04G4
ADAHSNLASIHKDAGNMAEAIQSYSTALKLKPDF

SEQ ID NO: 582 - protein, 34 aa, Artificial Sequence
  Description of Artificial Sequence: Synthetic segment of CELK04G6
IDAYINLAAALVSGGDLEQAVTAYFNALQINPDL

SEQ ID NO: 583 - protein, 34 aa, Artificial Sequence
  Description of Artificial Sequence: Synthetic segment of JC4775
VNALKDRAEAYLIEEMYDEAIQDYETAQEHNEND

SEQ ID NO: 584 - protein, 34 aa, Artificial Sequence
  Description of Artificial Sequence: Synthetic segment of ATU62130
AEACNNLGVLYKDRDNLDKAVECYQMALSIKPNF

SEQ ID NO: 585 - protein, 34 aa, Artificial Sequence
  Description of Artificial Sequence: Synthetic segment of ATU62131
AEAFNNLGVLYRDAGNITMAIDAYEECLKIDPDS

SEQ ID NO: 586 - protein, 34 aa, Artificial Sequence
  Description of Artificial Sequence: Synthetic segment of ATU62132
APAYYNLGVVYSEMMQYDNALSCYEKAALERPMY

SEQ ID NO: 587 - protein, 34 aa, Artificial Sequence
  Description of Artificial Sequence: Synthetic segment of ATU62133
VEAHIGKGICLQTQNKGNLAFDCFSEAIRLDPHN

SEQ ID NO: 588 - protein, 34 aa, Artificial Sequence
  Description of Artificial Sequence: Synthetic segment of YCA1_PL
AQRLKELGNKCFQEGKYEEAVKYFSDAITNDPLD

SEQ ID NO: 589 - protein, 34 aa, Artificial Sequence
  Description of Artificial Sequence: Synthetic segment of ATU62134
AQSLNNLGVVYTVQGKMDAAASMIEKAILANPTY

SEQ ID NO: 590 - protein, 34 aa, Artificial Sequence
  Description of Artificial Sequence: Synthetic segment of ATU62135
ADAMYNLGVAYGEMLKFDMAIVFYELAFHFNPHC

SEQ ID NO: 591 - protein, 34 aa, Artificial Sequence
  Description of Artificial Sequence: Synthetic segment of RNU7655
AEAYSNLGNVYKERGQLQEAIEHYRHALRLKPDF

SEQ ID NO: 592 - protein, 34 aa, Artificial Sequence
  Description of Artificial Sequence: Synthetic segment of ATU62136
AIVLTDLGTSLKLAGNTQEGIQKYYEALKIDPHY

SEQ ID NO: 593 - protein, 34 aa, Artificial Sequence
  Description of Artificial Sequence: Synthetic segment of PS43_TO
TEAYLNLARGHEKLCEFSEAVAYCRTCLGAEGGP

SEQ ID NO: 594 - protein, 34 aa, Artificial Sequence
  Description of Artificial Sequence: Synthetic segment of D82942
FNVRFRLGVALDNLGRFDEAIDSFKIALACVPMK

SEQ ID NO: 595 - protein, 34 aa, Artificial Sequence
  Description of Artificial Sequence: Synthetic segment of YPU2283
SRGLASAARAYRNEKRWDQALALWQSSLKKDPTN

SEQ ID NO: 596 - protein, 34 aa, Artificial Sequence
  Description of Artificial Sequence: Synthetic segment of CEUC55B6_3-59
VAKHLELGSQFLARAQFADALTQYHAAIELDPKS

SEQ ID NO: 597 - protein, 34 aa, Artificial Sequence
  Description of Artificial Sequence: Synthetic segment of S755780
AFVYYRDGMSAQADGEYAEALDNYEEALRLEENP

SEQ ID NO: 598 - protein, 34 aa, Artificial Sequence
  Description of Artificial Sequence: Synthetic segment of D86980
FKALYRSGVAFYHLGDYDKALYYLKEARTQQPTD

SEQ ID NO: 599 - protein, 34 aa, Artificial Sequence
  Description of Artificial Sequence: Synthetic segment of D86981
AKHYGNLGRLYQSMRKFKEAEEMHIKAIQIKEQL

SEQ ID NO: 600 - protein, 34 aa, Artificial Sequence
  Description of Artificial Sequence: Synthetic segment of H643320
TSILRQKASILEILGKLDEALDCVNKILSIKKDD

SEQ ID NO: 601 - protein, 34 aa, Artificial Sequence
  Description of Artificial Sequence: Synthetic segment of S55383
VKALYRRAQAYTQLADLELAEVDIKKALEIDPEN

SEQ ID NO: 602 - protein, 34 aa, Artificial Sequence
  Description of Artificial Sequence: Synthetic segment of YAD5_CL
GISYENLAWFYYLTGKYDKAIENFEKAISMGSTN

SEQ ID NO: 603 - protein, 34 aa, Artificial Sequence
  Description of Artificial Sequence: Synthetic segment of PPT1_YE
SIYFSNRAFAHFKVDNFQSALNDCDEAIKLDPKN

SEQ ID NO: 604 - protein, 34 aa, Artificial Sequence
  Description of Artificial Sequence: Synthetic segment of CELC33H
AQRLKEQGNEAFKKKKYHKAMTIYSKSLEHWPDP

SEQ ID NO: 605 - protein, 34 aa, Artificial Sequence
  Description of Artificial Sequence: Synthetic segment of CELC17G
AVLYFNRAAAQKHLGNLRSAIKDCSMGRKFDPTH

SEQ ID NO: 606 - protein, 34 aa, Artificial Sequence
  Description of Artificial Sequence: Synthetic segment of TPRD_HU0
CLAYCGIGKVYLKKNRFLEALNHFEKARTLIYRL

SEQ ID NO: 607 - protein, 34 aa, Artificial Sequence
  Description of Artificial Sequence: Synthetic segment of D64417
ASLWYFKGKLYEKQNKFEEALKYYNKAIQLMPHH

SEQ ID NO: 608 - protein, 34 aa, Artificial Sequence
  Description of Artificial Sequence: Synthetic segment of DMU18291
VYSYTLLGHELVLTEEFDKAMDYFRAAVVRDPRH

SEQ ID NO: 609 - protein, 34 aa, Artificial Sequence
  Description of Artificial Sequence: Synthetic segment of MXU7705
FIAQGNLGWAYYKKGEPDRAVESIKAAVTTNPNF

SEQ ID NO: 610 - protein, 34 aa, Artificial Sequence
  Description of Artificial Sequence: Synthetic segment of RSMGPGN0
GYAHLTIALAHLGMSQFQQCLESFESAMNVANET

SEQ ID NO: 611 - protein, 34 aa, Artificial Sequence
  Description of Artificial Sequence: Synthetic segment of CEF52H3
PSAYNNRAQAYRLQNKPEKALDDLNEALSLAGPK

SEQ ID NO: 612 - protein, 34 aa, Artificial Sequence
  Description of Artificial Sequence: Synthetic segment of CYP4_BO
TKALYRRAQGWQGLKEYDQALADLKKAQEIAPED

SEQ ID NO: 613 - protein, 34 aa, Artificial Sequence
  Description of Artificial Sequence: Synthetic segment of IEFS_HU0
AKAYARIGNSYFKEEKYKDAIHFYNKSLAEHRTP

SEQ ID NO: 614 - protein, 34 aa, Artificial Sequence
  Description of Artificial Sequence: Synthetic segment of S76202
TSLQLLLGEIYLSQNRPDQAIAIYEAASKVNGND

SEQ ID NO: 615 - protein, 34 aa, Artificial Sequence
  Description of Artificial Sequence: Synthetic segment of IEFS_HU2
IKGYTRKAAALEAMKDYTKAMDVYQKALDLDSSC

SEQ ID NO: 616 - protein, 34 aa, Artificial Sequence
  Description of Artificial Sequence: Synthetic segment of F64399
YKALFGLGKSYYLMSDNKNSIKYFEKVLELNPND

SEQ ID NO: 617 - protein, 34 aa, Artificial Sequence
  Description of Artificial Sequence: Synthetic segment of IEFS_HU3
MTYITNQAAVYFEKGDYNKCRELCEKAIEVGREN

SEQ ID NO: 618 - protein, 34 aa, Artificial Sequence
  Description of Artificial Sequence: Synthetic segment of SSN6_YE0
AKALTSLAHLYRSRDMFQRAAELYERALLVNPEL

SEQ ID NO: 619 - protein, 34 aa, Artificial Sequence
  Description of Artificial Sequence: Synthetic segment of YHR7_YE0
AVQLKNRGNHFFTAKNFNEAIKYYQYAIELDPNE

SEQ ID NO: 620 - protein, 34 aa, Artificial Sequence
  Description of Artificial Sequence: Synthetic segment of IEFS_HU4
GKGYSRKAAALEFLNRFEEAKRTYEEGLKHEANN

SEQ ID NO: 621 - protein, 34 aa, Artificial Sequence
  Description of Artificial Sequence: Synthetic segment of SSN6_YE1
SDVWATLGHCYLMLDDLQRAYNAYQQALYHLSNP

SEQ ID NO: 622 - protein, 34 aa, Artificial Sequence
  Description of Artificial Sequence: Synthetic segment of SSN6_YE2
WDIWFQLGSVLESMGEWQGAKEAYEHVLAQNQHH

SEQ ID NO: 623 - protein, 34 aa, Artificial Sequence
  Description of Artificial Sequence: Synthetic segment of SSN6_YE3
PKLWHGIGILYDRYGSLDYAEEAFAKVLELDPHF

SEQ ID NO: 624 - protein, 34 aa, Artificial Sequence
  Description of Artificial Sequence: Synthetic segment of HEMY_EC
PLLWSTLGQSLMKHGEWQEASLAFRAALKQRPDA

SEQ ID NO: 625 - protein, 34 aa, Artificial Sequence
  Description of Artificial Sequence: Synthetic segment of SSN6_YE4
ATTWYHLGRVHMIRTDYTAAYDAFQQAVNRDSRN

SEQ ID NO: 626 - protein, 34 aa, Artificial Sequence
  Description of Artificial Sequence: Synthetic segment of SSN6_YE5
NEIYFRLGIIYKHQGKWSQALECFRYILPQPPAP

SEQ ID NO: 627 - protein, 34 aa, Artificial Sequence
  Description of Artificial Sequence: Synthetic segment of RSMGPGN
FGALAGLGTMLEQMDRPKPALEAYRAALAIHPHL

SEQ ID NO: 628 - protein, 34 aa, Artificial Sequence
  Description of Artificial Sequence: Synthetic segment of CYP7_YE
AKAYYRRGNSYLKKKRLDEALQDYIFCKEKNPDD

SEQ ID NO: 629 - protein, 34 aa, Artificial Sequence
  Description of Artificial Sequence: Synthetic segment of S76685
AIAFFNLAMIYKAQGNLLEAIKGYQEAITLQPDY

SEQ ID NO: 630 - protein, 34 aa, Artificial Sequence
  Description of Artificial Sequence: Synthetic segment of A55346
AEELKTQANDYFKAKDYENAIKFYSKAIELNPSN

SEQ ID NO: 631 - protein, 34 aa, Artificial Sequence
  Description of Artificial Sequence: Synthetic segment of CELC18H
FRALGCLITAHSEMGKYEDMLRFAVAQSEAARQM

SEQ ID NO: 632 - protein, 34 aa, Artificial Sequence
  Description of Artificial Sequence: Synthetic segment of S761560
VWAYINRGVAYYDLGCHQKSLDDYNQALVIDSKC

SEQ ID NO: 633 - protein, 34 aa, Artificial Sequence
  Description of Artificial Sequence: Synthetic segment of S761561
VSSYILRAEIHNLLGDFDAAIEDCFTSLRLNPMH

SEQ ID NO: 634 - protein, 34 aa, Artificial Sequence
  Description of Artificial Sequence: Synthetic segment of NASP_HU
AETHYQLGLAYGYNSQYDEAVAQFSKSIEVIENR

SEQ ID NO: 635 - protein, 34 aa, Artificial Sequence
  Description of Artificial Sequence: Synthetic segment of S761562
HEHLFKLGVEQYILGNISDAIDSFTKALEFNDRF

SEQ ID NO: 636 - protein, 34 aa, Artificial Sequence
  Description of Artificial Sequence: Synthetic segment of CELF10C0
AALWVLIGHEFMEMKNNAAACVSYRRAIEIDPAD

SEQ ID NO: 637 - protein, 34 aa, Artificial Sequence
  Description of Artificial Sequence: Synthetic segment of S761563
DNTLYILGSSFLSLEKYQSAIDYLDQSLALNGNL

SEQ ID NO: 638 - protein, 34 aa, Artificial Sequence
  Description of Artificial Sequence: Synthetic segment of C64478
PIDWFNLAYALYHLEKYDSALEAINEALKISPSN

SEQ ID NO: 639 - protein, 34 aa, Artificial Sequence
  Description of Artificial Sequence: Synthetic segment of CEF10B50
VDAIASTALCYAVLGNIDKATEFFNKALAIDPFN

SEQ ID NO: 640 - protein, 34 aa, Artificial Sequence
  Description of Artificial Sequence: Synthetic segment of ATAC98_24-445
VDALYNLGGLYMDLGRFQRASEMYTRVLTVWPNH

SEQ ID NO: 641 - protein, 34 aa, Artificial Sequence
  Description of Artificial Sequence: Synthetic segment of A565190
ASTYSAIGYIHSLMGNFENAVDYFHTALGLRRDD

SEQ ID NO: 642 - protein, 34 aa, Artificial Sequence
  Description of Artificial Sequence: Synthetic segment of E644170
  MOD_RES (8)..(8): Any amino acid
VALWYFKXELYERLGKLDEALKCYEKVIELQPHY

SEQ ID NO: 643 - protein, 34 aa, Artificial Sequence
  Description of Artificial Sequence: Synthetic segment of E644171
PITWVFVGQLYGMSGNCDEALKCYNKALGIENRF

SEQ ID NO: 644 - protein, 34 aa, Artificial Sequence
  Description of Artificial Sequence: Synthetic segment of E644172
  MOD_RES (14)..(14): Any amino acid
IKALLSKARIYERXGNIEAAIEYYNKAVENIHKD

SEQ ID NO: 645 - protein, 34 aa, Artificial Sequence
  Description of Artificial Sequence: Synthetic segment of CELF10C
HRGWYGLGQMYDIMKMPAYALFYYQEAQKCKPHD

SEQ ID NO: 646 - protein, 34 aa, Artificial Sequence
  Description of Artificial Sequence: Synthetic segment of E644173
YLALFLKGLALSAKGEIKEAITTFEELLSYESKN

SEQ ID NO: 647 - protein, 34 aa, Artificial Sequence
  Description of Artificial Sequence: Synthetic segment of CYP4_BO0
LSCVLNIGACKLKMSDWQGAVDSCLEALEIDPSN

SEQ ID NO: 648 - protein, 34 aa, Artificial Sequence
  Description of Artificial Sequence: Synthetic segment of CYP4_BO1
SEDLKNIGNTFFKSQNWEMAIKKYTKVLRYVEGS

SEQ ID NO: 649 - protein, 34 aa, Artificial Sequence
  Description of Artificial Sequence: Synthetic segment of MMU2783
VNELKEKGNKALSAGNIDDALQCYSEAIKLDPQN

SEQ ID NO: 650 - protein, 34 aa, Artificial Sequence
  Description of Artificial Sequence: Synthetic segment of S752020
FNELLRQGKAYVDNGNFPQAIAIYQQAAMLDGEN

SEQ ID NO: 651 - protein, 34 aa, Artificial Sequence
  Description of Artificial Sequence: Synthetic segment of ENAC0
LETMNNMALAYEGLGKYKEAEEIWAQLLELANEC

SEQ ID NO: 652 - protein, 34 aa, Artificial Sequence
  Description of Artificial Sequence: Synthetic segment of PFCYT12
AEGLYFLGRAYMAQDRSADAAKVFERAVALAGRQ

SEQ ID NO: 653 - protein, 34 aa, Artificial Sequence
  Description of Artificial Sequence: Synthetic segment of CC16_YE
SEIHCSLGYLYLKTKKLQKAIDHLHKSLYLKPNN

SEQ ID NO: 654 - protein, 34 aa, Artificial Sequence
  Description of Artificial Sequence: Synthetic segment of BSATPC1
GSALYNIGNCYDDKGELDQAAEYFEKALPVFEDY

SEQ ID NO: 655 - protein, 34 aa, Artificial Sequence
  Description of Artificial Sequence: Synthetic segment of ECAE00
ARGYAAVAVAYRNLQQWQNSLTLWQKALSLEPQN

SEQ ID NO: 656 - protein, 34 aa, Artificial Sequence
  Description of Artificial Sequence: Synthetic segment of ECAE01
AGGYYGLARLAARNGNFDAGLDFCQQSLRACPTN

SEQ ID NO: 657 - protein, 34 aa, Artificial Sequence
  Description of Artificial Sequence: Synthetic segment of ECAE02
WFARHLLACFYYNKRSYNKAIAFWQRCVEMSPEF

SEQ ID NO: 658 - protein, 34 aa, Artificial Sequence
  Description of Artificial Sequence: Synthetic segment of YAD5_CL0
NSVYRSLGITYAKIGDYKKSEEYLKKALDAEPEK

SEQ ID NO: 659 - protein, 34 aa, Artificial Sequence
  Description of Artificial Sequence: Synthetic segment of PR06_YEAST-701
HKFFLQLGQIYHSMGNIEMSRETYLSGTRLVPNC

SEQ ID NO: 660 - protein, 34 aa, Artificial Sequence
  Description of Artificial Sequence: Synthetic segment of YAD5_CL1
INDVYSFALSYHILGEPERALKYFLRAVELQPNV

SEQ ID NO: 661 - protein, 34 aa, Artificial Sequence
  Description of Artificial Sequence: Synthetic segment of YPIA_BA
VNVHQRLAESLSASGEFEDAIPWYEKAVDENPDP

SEQ ID NO: 662 - protein, 34 aa, Artificial Sequence
  Description of Artificial Sequence: Synthetic segment of NCF2_HU0
SRICFNIGCMYTILKNMTEAEKAFTRSINRDKHL

SEQ ID NO: 663 - protein, 34 aa, Artificial Sequence
  Description of Artificial Sequence: Synthetic segment of TPU93844_2-211
SVAYFYLGEIFRLTKRFRKADIAYSTAVNFEPSN

SEQ ID NO: 664 - protein, 34 aa, Artificial Sequence
  Description of Artificial Sequence: Synthetic segment of SKI3_YE
VESWVGLGQAYHACGRIEASIKVFDKAIQLRPSH

SEQ ID NO: 665 - protein, 34 aa, Artificial Sequence
  Description of Artificial Sequence: Synthetic segment of YHJL_EC
SEALGALGQAYSQKGDRANAVANLEKALALDPHS

SEQ ID NO: 666 - protein, 34 aa, Artificial Sequence
  Description of Artificial Sequence: Synthetic segment of ECAE0
ASLYYYRALVHFHNEKIEEARICIDKSLQLEPRR

SEQ ID NO: 667 - protein, 34 aa, Artificial Sequence
  Description of Artificial Sequence: Synthetic segment of C644780
SRWWYVKGYIYYKLGNYKDAYESFMNALRVNPKD

SEQ ID NO: 668 - protein, 34 aa, Artificial Sequence
  Description of Artificial Sequence: Synthetic segment of OM70_YE
ALALKDKGNQFFRNKKYDDAIKYYNWALELKEDP

SEQ ID NO: 669 - protein, 34 aa, Artificial Sequence
  Description of Artificial Sequence: Synthetic segment of C644781
SLYYAKKGDILYKLGDEEGAIEAYNKAIKLNSQN

SEQ ID NO: 670 - protein, 34 aa, Artificial Sequence
  Description of Artificial Sequence: Synthetic segment of C644782
YEDWVTEANYYLDEGIYDKAVECYLKALEKKNTN

SEQ ID NO: 671 - protein, 34 aa, Artificial Sequence
  Description of Artificial Sequence: Synthetic segment of C644783
LNALFKAGKIYLLFGDIDKAYDAFNEILQQNPSH

SEQ ID NO: 672 - protein, 34 aa, Artificial Sequence
  Description of Artificial Sequence: Synthetic segment of A64512
AIALSEIAKAQYNIGMHDEALKNYDKAIFITEGV

SEQ ID NO: 673 - protein, 34 aa, Artificial Sequence
  Description of Artificial Sequence: Synthetic segment of LMU7384
AKGYVRRGAALHGMRRYDDAIAAYEKGLKVDPSN

SEQ ID NO: 674 - protein, 34 aa, Artificial Sequence
  Description of Artificial Sequence: Synthetic segment of C644784
ISTLKSLAIVLEKSGKIDEAITTYTKILKIVNSL

SEQ ID NO: 675 - protein, 34 aa, Artificial Sequence
  Description of Artificial Sequence: Synthetic segment of PTSR_HU
PDVQCGLGVLFNLSGEYDKAVDCFTAALSVRPND

SEQ ID NO: 676 - protein, 34 aa, Artificial Sequence
  Description of Artificial Sequence: Synthetic segment of HSU4657
AETFKEQGNAYYAKKDYNEAYNYYTKAIDMCPKN

SEQ ID NO: 677 - protein, 34 aa, Artificial Sequence
  Description of Artificial Sequence: Synthetic segment of CELK04G
ADAYSNMGNTLKEMGDSSAAIACYNRAIQINPAF

SEQ ID NO: 678 - protein, 34 aa, Artificial Sequence
  Description of Artificial Sequence: Synthetic segment of YKD1_CA0
PEMLNNVGALYMSMKQYEKAEHHFKRAKERLEEQ

SEQ ID NO: 679 - protein, 34 aa, Artificial Sequence
  Description of Artificial Sequence: Synthetic segment of YKD1_CA1
TLAHYGLGQMYIHRNEIEEAIKCFDTVHKRLPNN

SEQ ID NO: 680 - protein, 34 aa, Artificial Sequence
  Description of Artificial Sequence: Synthetic segment of S619910
FRGYSRLGFAKYAQGKPEEALEAYKKVLDIEGDN

SEQ ID NO: 681 - protein, 34 aa, Artificial Sequence
  Description of Artificial Sequence: Synthetic segment of S619911
AEDLKMQGNKAMANKDYELAINKYTEAIKVLPTN

SEQ ID NO: 682 - protein, 34 aa, Artificial Sequence
  Description of Artificial Sequence: Synthetic segment of YKD1_CA2
AEAFYQMGRCRHAQGQFDGAYKYYYQARQANNGE

SEQ ID NO: 683 - protein, 34 aa, Artificial Sequence
  Description of Artificial Sequence: Synthetic segment of SR72_CA
AIIHGQMAYILQLQGRTEEALQLYNQIIKLKPTD

SEQ ID NO: 684 - protein, 34 aa, Artificial Sequence
  Description of Artificial Sequence: Synthetic segment of CELT09B
PKYYQNRAMCYFQLNNLKMTEEDCKRALELSPNE

SEQ ID NO: 685 - protein, 34 aa, Artificial Sequence
  Description of Artificial Sequence: Synthetic segment of MXU77058_2-100
PDANNAMGILLHLAFRRPDEAVKHYTKALEVRPD

SEQ ID NO: 686 - protein, 34 aa, Artificial Sequence
  Description of Artificial Sequence: Synthetic segment of NRFG_EC
SEQWALLGEYYLWQNDYSNSLLAYRQALQLRGEN

SEQ ID NO: 687 - protein, 34 aa, Artificial Sequence
  Description of Artificial Sequence: Synthetic segment of NRFF_HA
AETWLQLGEAYVQNNEFDSALVAYSNAEKLSGSK

SEQ ID NO: 688 - protein, 34 aa, Artificial Sequence
  Description of Artificial Sequence: Synthetic segment of CELT25F
ADVWYNIGQILVDIGDLVSAARSFRIALSHDPDH

SEQ ID NO: 689 - protein, 34 aa, Artificial Sequence
  Description of Artificial Sequence: Synthetic segment of S45064
GQVSLSMGNAFLGLSVFQKALESFEKALRYAHNN

SEQ ID NO: 690 - protein, 34 aa, Artificial Sequence
  Description of Artificial Sequence: Synthetic segment of S76315
YLRYRALATTYRDLEKYDLAMANIDRALAITPDN

SEQ ID NO: 691 - protein, 34 aa, Artificial Sequence
  Description of Artificial Sequence: Synthetic segment of CEAF16427_7-686
VTVLQNIALAEFHMQNYNRSLLFYRKALHLDPTH

SEQ ID NO: 692 - protein, 34 aa, Artificial Sequence
  Description of Artificial Sequence: Synthetic segment of BIMA_EM0
ANVHYLLGKLYKMLRDKGNAIKHFTTALNLDPKA

SEQ ID NO: 693 - protein, 34 aa, Artificial Sequence
  Description of Artificial Sequence: Synthetic segment of BIMA_EM1
AAVLCLQGKLWQAHKEHNKAVECYAAALKLNPFM

SEQ ID NO: 694 - protein, 34 aa, Artificial Sequence
  Description of Artificial Sequence: Synthetic segment of S76156
FNGFYNRGLAYYKMGQIKKAIKDFSDALIVKPTF

SEQ ID NO: 695 - protein, 34 aa, Artificial Sequence
  Description of Artificial Sequence: Synthetic segment of BIMA_EM2
AVLICCIGLVLEKMNNPKSALIQYNRACTLAPHS

SEQ ID NO: 696 - protein, 34 aa, Artificial Sequence
  Description of Artificial Sequence: Synthetic segment of BIMA_EM3
AYGFTLQGHEYVANEEYDKALDAYRSGINADSRH

SEQ ID NO: 697 - protein, 34 aa, Artificial Sequence
  Description of Artificial Sequence: Synthetic segment of NUC2_SC1
SVLITCIGMIYERCKDYKKALDFYDRACKLDEKS

SEQ ID NO: 698 - protein, 34 aa, Artificial Sequence
  Description of Artificial Sequence: Synthetic segment of JC4348
GRVYNLLGNISFDQTNLKKALKYYQIAYQLFDGN

SEQ ID NO: 699 - protein, 34 aa, Artificial Sequence
  Description of Artificial Sequence: Synthetic segment of LBAPREL
AMTLNNMGELYHYKNEHDKSKSYFLQSFQLQQTV

SEQ ID NO: 700 - protein, 34 aa, Artificial Sequence
  Description of Artificial Sequence: Synthetic segment of YO91_CA0
LGTWFNAGYCAWKLENFKESTQCYHRCVSLQPDH

SEQ ID NO: 701 - protein, 34 aa, Artificial Sequence
  Description of Artificial Sequence: Synthetic segment of PTSR_YE
PEIQLCLGLLFYTKDDFDKTIDCFESALRVNPND

SEQ ID NO: 702 - protein, 34 aa, Artificial Sequence
  Description of Artificial Sequence: Synthetic segment of A60088
ALCLLCFADIHRHRSDIGKALPRYESSLNIMTEI

SEQ ID NO: 703 - protein, 34 aa, Artificial Sequence
  Description of Artificial Sequence: Synthetic segment of BSU55040
VQACYDLAIIFFKQGRKEEALDYCVKGKSYAEKY

SEQ ID NO: 704 - protein, 34 aa, Artificial Sequence
  Description of Artificial Sequence: Synthetic segment of ATAC0
PESWCAVGNCYSLRKDHDTALKMFQRAIQLNERF

SEQ ID NO: 705 - protein, 34 aa, Artificial Sequence
  Description of Artificial Sequence: Synthetic segment of D64371
AEYYYKKGVEVGNKGDVEKALEYFNKAIELNPFY

SEQ ID NO: 706 - protein, 34 aa, Artificial Sequence
  Description of Artificial Sequence: Synthetic segment of H64332
AHAWYLKGRILKKLGNIKEALDALKMAINLNENL

SEQ ID NO: 707 - protein, 34 aa, Artificial Sequence
  Description of Artificial Sequence: Synthetic segment of S748060
TSAWQNRGSALGVMGKLEEALANFDEALAQNPDD

SEQ ID NO: 708 - protein, 34 aa, Artificial Sequence
  Description of Artificial Sequence: Synthetic segment of S748061
AEDWLNLGIQQAQRGELETAIASWGEAISLNPQM

SEQ ID NO: 709 - protein, 34 aa, Artificial Sequence
  Description of Artificial Sequence: Synthetic segment of YREC_SY0
LNALLEQGNEQLTNRNFAQAVQHYRQALTLEANN

SEQ ID NO: 710 - protein, 34 aa, Artificial Sequence
  Description of Artificial Sequence: Synthetic segment of YREC_SY1
LAYSLGLATVQFRAGDYDQALVAYRKVLAKDSNN

SEQ ID NO: 711 - protein, 34 aa, Artificial Sequence
  Description of Artificial Sequence: Synthetic segment of YREC_SY2
AEFFNALGFNLAQSGDNRSAINAYQRATQLQPNN

SEQ ID NO: 712 - protein, 34 aa, Artificial Sequence
  Description of Artificial Sequence: Synthetic segment of NPRA_BA
YYYYKFLGLLYYCKEKYEDALEYYKKAEQRFRSQ

SEQ ID NO: 713 - protein, 34 aa, Artificial Sequence
  Description of Artificial Sequence: Synthetic segment of JC47750
TAARLQRGHLLLKQGKLDEAEDDFKKVLKSNPSE

SEQ ID NO: 714 - protein, 34 aa, Artificial Sequence
  Description of Artificial Sequence: Synthetic segment of G020580
AFAYTDLANMYAEGGQYSNAEDIFRKALRLENIT

SEQ ID NO: 715 - protein, 34 aa, Artificial Sequence
  Description of Artificial Sequence: Synthetic segment of PPP5_RA
IKGYYRRAASNMALGKFRAALRDYETVVKVKPND

SEQ ID NO: 716 - protein, 34 aa, Artificial Sequence
  Description of Artificial Sequence: Synthetic segment of YQCH_BA
ATAFFNLGNCYHKMDNLNKAARYIEQALVQYRKI

SEQ ID NO: 717 - protein, 34 aa, Artificial Sequence
  Description of Artificial Sequence: Synthetic segment of CC27_HU2
SVLLCHIGVVQHALKKSEKALDTLNKAIVIDPKN

SEQ ID NO: 718 - protein, 34 aa, Artificial Sequence
  Description of Artificial Sequence: Synthetic segment of S61991
AIYYANRAAAHSSLKEYDQAVKDAESAISIDPSY

SEQ ID NO: 719 - protein, 34 aa, Artificial Sequence
  Description of Artificial Sequence: Synthetic segment of YREC_SY
ARIHGALGYALSQLGNYSEAVTAYRRATELEDDN

SEQ ID NO: 720 - protein, 34 aa, Artificial Sequence
  Description of Artificial Sequence: Synthetic segment of CC27_HU3
CFTLSLLGHVYCKTDRLAKGSECYQKSLSLNPFL

SEQ ID NO: 721 - protein, 34 aa, Artificial Sequence
  Description of Artificial Sequence: Synthetic segment of CC27_HU4
SLVYFLIGKVYKKLGQTHLALMNFSWAMDLDPKG

SEQ ID NO: 722 - protein, 30 aa, Artificial Sequence
  Description of Artificial Sequence: Synthetic segment of O04242/1-30
NGHTALHIAASKGDEQCVKLLLEHGADPNA

SEQ ID NO: 723 - protein, 30 aa, Artificial Sequence
  Description of Artificial Sequence: Synthetic segment of O93130/1-30
DGYTPLHYAIKYNTIRIAKYLLDNGADMTL

SEQ ID NO: 724 - protein, 32 aa, Artificial Sequence
  Description of Artificial Sequence: Synthetic segment of VB18_VARV/1-32
TGYTALHCYLYNNYFTNDVLKVLLNHGVDVTI

SEQ ID NO: 725 - protein, 30 aa, Artificial Sequence
  Description of Artificial Sequence: Synthetic segment of Q25328/1-30
DKDTALHLAVYYKNLQMIKLLIKYGIDVTI

SEQ ID NO: 726 - protein, 30 aa, Artificial Sequence
  Description of Artificial Sequence: Synthetic segment of Q14349_1/1-30
GGWTPIIWAAEHKHIEVIRMLLTRGADVTL

SEQ ID NO: 727 - protein, 30 aa, Artificial Sequence
  Description of Artificial Sequence: Synthetic segment of BCL3_HUMAN/1-30
SGRSPLIHAVENNSLSMVQLLLQHGANVNA

SEQ ID NO: 728 - protein, 31 aa, Artificial Sequence
  Description of Artificial Sequence: Synthetic segment of Q24241_4/1-31
DGLTPLHCASRSGHVEVIKHLLQQNAPILTK

SEQ ID NO: 729 - protein, 30 aa, Artificial Sequence
  Description of Artificial Sequence: Synthetic segment of O43150/1-30
KGSTALHYCCLTDNAECLKLLLRGKASIEI

SEQ ID NO: 730 - protein, 30 aa, Artificial Sequence
  Description of Artificial Sequence: Synthetic segment of G3790744/1-30
NKQTSLHYACSKNHVEIVKLLIEADPNIIN

SEQ ID NO: 731 - protein, 30 aa, Artificial Sequence
  Description of Artificial Sequence: Synthetic segment of Q25328_3/1-30
EKYTPLHLAAMSKYPELIQILLDQGSNFEA

SEQ ID NO: 732 - protein, 30 aa, Artificial Sequence
  Description of Artificial Sequence: Synthetic segment of GLP1_CAEEL/1-30
KGRTALHYAAMHDNEEMVIMLVRRSSNKDK

SEQ ID NO: 733 - protein, 31 aa, Artificial Sequence
  Description of Artificial Sequence: Synthetic segment of YA2A_SCHPO/1-31
DKMTPLHWSIVGGNLKCMKLILKEGGIPCTA

SEQ ID NO: 734 - protein, 30 aa, Artificial Sequence
  Description of Artificial Sequence: Synthetic segment of VB04_VACCC/1-30
NRYTPLHYVSCRNKYDFVKLLISKGANVNA

SEQ ID NO: 735 - protein, 33 aa, Artificial Sequence
  Description of Artificial Sequence: Synthetic segment of HT16_HYDAT/1-33
GLDTRLHLACEEKNPNTVKELLQDSVIKENVNA

SEQ ID NO: 736 - protein, 30 aa, Artificial Sequence
  Description of Artificial Sequence: Synthetic segment of O04703_1/1-30
HRSTAIHVAIEENHLEMVKLLLLNGDEIDD

SEQ ID NO: 737 - protein, 30 aa, Artificial Sequence
  Description of Artificial Sequence: Synthetic segment of G3790744_1/1-30
EGNTALHLACDENRGDVAILLVNRGADMKM

SEQ ID NO: 738 - protein, 30 aa, Artificial Sequence
  Description of Artificial Sequence: Synthetic segment of Q25338_1/1-30
GNLTVLHLAVSTGQINIIKELLKRGSNIEE

SEQ ID NO: 739 - protein, 30 aa, Artificial Sequence
  Description of Artificial Sequence: Synthetic segment of Q21920/1-30
TLETPLTIACANGHKDIVELLLKEGANIEH

SEQ ID NO: 740 - protein, 30 aa, Artificial Sequence
  Description of Artificial Sequence: Synthetic segment of O16568/1-30
DGKTCLHVAIENLHKETIELMIQSGADKYA

SEQ ID NO: 741 - protein, 30 aa, Artificial Sequence
  Description of Artificial Sequence: Synthetic segment of Q21920_1/1-30
TGDTPLSLAARNGYIAIMKMLIEKGGDLTA

SEQ ID NO: 742 - protein, 30 aa, Artificial Sequence
  Description of Artificial Sequence: Synthetic segment of O82630/1-30
DGRSPLHLAASRGYEDITLYLIQESVDVNI

SEQ ID NO: 743 - protein, 31 aa, Artificial Sequence
  Description of Artificial Sequence: Synthetic segment of O00542/1-31
QSRTLLHHAVSTGSKDVVRYLLDHAPPEILD

SEQ ID NO: 744 - protein, 30 aa, Artificial Sequence
  Description of Artificial Sequence: Synthetic segment of Q25338_2/1-30
DGSTALHLAVSGRKMKTVETLLNKGANLKE

SEQ ID NO: 745 - protein, 32 aa, Artificial Sequence
  Description of Artificial Sequence: Synthetic segment of Q86916/1-32
NGKNLLHMYMCNFNVRINVIKLLIDSGVNFLQ

SEQ ID NO: 746 - protein, 30 aa, Artificial Sequence
  Description of Artificial Sequence: Synthetic segment of Q23595/1-30
IGQNALHMAARVGNLNILKYLLDRLPELRD

SEQ ID NO: 747 - protein, 30 aa, Artificial Sequence
  Description of Artificial Sequence: Synthetic segment of Q21587/1-30
IGCSALHLCAEHGHYRMIKLLLQYMKVVEQ

SEQ ID NO: 748 - protein, 34 aa, Artificial Sequence
  Description of Artificial Sequence: Synthetic segment of P87621/1-34
DGNTPLHIVCSKTVKNVDIIDLLLPSTDVNKQNK

SEQ ID NO: 749 - protein, 33 aa, Artificial Sequence
  Description of Artificial Sequence: Synthetic segment of YD57_SCHPO/1-33
AGWTPLMISINNRSVPDNVIEELINRSDVDPTI

SEQ ID NO: 750 - protein, 30 aa, Artificial Sequence
  Description of Artificial Sequence: Synthetic segment of O04097_1/1-30
HGRTPLHHCISSGNHKFAKILLRRGARPSI

SEQ ID NO: 751 - protein, 30 aa, Artificial Sequence
  Description of Artificial Sequence: Synthetic segment of P87621_2/1-30
YDSTDFKMAVEVGSIRCVKYLLDNDIICED

SEQ ID NO: 752 - protein, 30 aa, Artificial Sequence
  Description of Artificial Sequence: Synthetic segment of Q84644_1/1-30
YGNTPLAIAISTGQCDMVKLLMNYVTNIFD

SEQ ID NO: 753 - protein, 31 aa, Artificial Sequence
  Description of Artificial Sequence: Synthetic segment of O17055_1/1-31
YGDTALHLSCYSGRLDIVKSILDSSPTNIVN

SEQ ID NO: 754 - protein, 33 aa, Artificial Sequence
  Description of Artificial Sequence: Synthetic segment of VB18_VARV_1/1-3
CGNTPFHLYLSIEMCNNIHMTKMLLTFNPNFEI

SEQ ID NO: 755 - protein, 32 aa, Artificial Sequence
  Description of Artificial Sequence: Synthetic segment of HRG_COWPX/1-32
NYCTALQYYIKSSHIDIDIVKLLMKGIDNTAY

SEQ ID NO: 756 - protein, 30 aa, Artificial Sequence
  Description of Artificial Sequence: Synthetic segment of O55222_1/1-30
HGFSPLHWACREGRSAVVEMLIMRGARINV

SEQ ID NO: 757 - protein, 30 aa, Artificial Sequence
  Description of Artificial Sequence: Synthetic segment of Q28282/1-30
EGRSAFHVVASKGNLECLNAILIHGVDITT

SEQ ID NO: 758 - protein, 30 aa, Artificial Sequence
  Description of Artificial Sequence: Synthetic segment of G3929219_3/1-30
DFMTPLHVAAERAHNDVMEVLHKHGAKMNA

SEQ ID NO: 759 - protein, 34 aa, Artificial Sequence
  Description of Artificial Sequence: Synthetic segment of BCL3_HUMAN_1/1-
DGDTPLHIAVVQGNLPAVHRLVNLFQQGGRELDI

SEQ ID NO: 760 - protein, 32 aa, Artificial Sequence
  Description of Artificial Sequence: Synthetic segment of BCL3_HUMAN_2/1-
HGQTAAHLACEHRSPTCLRALLDSAAPGTLDL

SEQ ID NO: 761 - protein, 30 aa, Artificial Sequence
  Description of Artificial Sequence: Synthetic segment of O73630/1-30
HGLSPVHWSVKMKNEKCLVLLVKAGANVNS

SEQ ID NO: 762 - protein, 30 aa, Artificial Sequence
  Description of Artificial Sequence: Synthetic segment of Q18297_2/1-30
DQNTPMHIVASNGYLEMMQLLQKHGASITQ

SEQ ID NO: 763 - protein, 31 aa, Artificial Sequence
  Description of Artificial Sequence: Synthetic segment of Q94527/1-31
DGLTPLHMAIRQNKYDVAKKLISYDRTSISV

SEQ ID NO: 764 - protein, 30 aa, Artificial Sequence
  Description of Artificial Sequence: Synthetic segment of O90757/1-30
KGYTALYYTICNNNYDMVCFLLEKNADISI

SEQ ID NO: 765 - protein, 31 aa, Artificial Sequence
  Description of Artificial Sequence: Synthetic segment of HT16_HYDAT_2/1-
NGRTPVQVVCFYNHASTLHLLISKGSADFLK

SEQ ID NO: 766 - protein, 31 aa, Artificial Sequence
  Description of Artificial Sequence: Synthetic segment of P87609_1/1-31
NGYTCIAIAINESRNIELLKMLLCHKPTLDC

SEQ ID NO: 767 - protein, 30 aa, Artificial Sequence
  Description of Artificial Sequence: Synthetic segment of O90757_1/1-30
GGRTSLHLAIKERNYEAAFVLINNGANVDS

SEQ ID NO: 768 - protein, 31 aa, Artificial Sequence
  Description of Artificial Sequence: Synthetic segment of Q20109_1/1-31
MGWSPLMWAVYKNHLDVVDLLVNAKVNACDK

SEQ ID NO: 769 - protein, 30 aa, Artificial Sequence
  Description of Artificial Sequence: Synthetic segment of SWI6_YEAST_1/1-
HGNTPLHWLTSIANLELVKHLVKHGSNRLY

SEQ ID NO: 770 - protein, 31 aa, Artificial Sequence
  Description of Artificial Sequence: Synthetic segment of P93755/1-31
DYRTPLMVAATYGSIDVIKLIVSLTDADVNR

SEQ ID NO: 771 - protein, 31 aa, Artificial Sequence
  Description of Artificial Sequence: Synthetic segment of Q19995/1-31
AGRTPLHYAAADPNGEHMIKVLQKSGGDAFI

SEQ ID NO: 772 - protein, 30 aa, Artificial Sequence
  Description of Artificial Sequence: Synthetic segment of O48738/1-30
DGFTPIHMAAKEGHVRIIKEFLKHCPDSRE

SEQ ID NO: 773 - protein, 30 aa, Artificial Sequence
  Description of Artificial Sequence: Synthetic segment of Q89202/1-30
ILLSCIHITIKNGHVDMMILLLDYMTSTNT

SEQ ID NO: 774 - protein, 30 aa, Artificial Sequence
  Description of Artificial Sequence: Synthetic segment of G3927831_1/1-30
HKQTPLMLAAMYGRISCVKKLAEVGANILM

SEQ ID NO: 775 - protein, 30 aa, Artificial Sequence
  Description of Artificial Sequence: Synthetic segment of FEM1_CAEEL_3/1-
HGHTCLMIASYRNKVGIVEELLKTGIDVNK

SEQ ID NO: 776 - protein, 30 aa, Artificial Sequence
  Description of Artificial Sequence: Synthetic segment of Q18297_3/1-30
EGKTAFDIACENDHKDVARAFLETDQWKNL

SEQ ID NO: 777 - protein, 30 aa, Artificial Sequence
  Description of Artificial Sequence: Synthetic segment of Q38898_1/1-30
HGVTALQVAMAEDQMDMVNLLATNGADVVC

SEQ ID NO: 778 - protein, 31 aa, Artificial Sequence
  Description of Artificial Sequence: Synthetic segment of HRG_COWPX_2/1-3
NDFNIFTYMKSKNVDIDLIKVLVEHGFDFSV

SEQ ID NO: 779 - protein, 30 aa, Artificial Sequence
  Description of Artificial Sequence: Synthetic segment of O43988/1-30
EGYTPIHYAVRESRIETVKFLIKFNSKLNI

SEQ ID NO: 780 - protein, 30 aa, Artificial Sequence
  Description of Artificial Sequence: Synthetic segment of O43988_1/1-30
QGYTPLYLAAKAGKTNFVKYLLSKGRSKKI

SEQ ID NO: 781 - protein, 30 aa, Artificial Sequence
  Description of Artificial Sequence: Synthetic segment of AKR1_YEAST/1-30
EGFTPLHWGTVKGQPHVLKYLIQDGADFFQ

SEQ ID NO: 782 - protein, 30 aa, Artificial Sequence
  Description of Artificial Sequence: Synthetic segment of Q21920_5/1-30
TKDTALTISAEKGHEKFVRMLLNGDAAVDV

SEQ ID NO: 783 - protein, 32 aa, Artificial Sequence
  Description of Artificial Sequence: Synthetic segment of P87621_3/1-32
QHKTPLYYLSGTDDEVIERINLLVRYGAKINN

SEQ ID NO: 784 - protein, 30 aa, Artificial Sequence
  Description of Artificial Sequence: Synthetic segment of O18270_1/1-30
EGRSCLMWAVCAGNIEVINYLIQREDAPKR

SEQ ID NO: 785 - protein, 33 aa, Artificial Sequence
  Description of Artificial Sequence: Synthetic segment of VC17_VACCC/1-33
RGNNALHCYVSNKCDTDIKIVRLLLSRGVERLC

SEQ ID NO: 786 - protein, 30 aa, Artificial Sequence
  Description of Artificial Sequence: Synthetic segment of VC09_VACCC/1-30
HGCSILYHCIKSHSVSLVEWLIDNGADINI

SEQ ID NO: 787 - protein, 30 aa, Artificial Sequence
  Description of Artificial Sequence: Synthetic segment of YIA1_YEAST/1-30
FDNSPLFLASLCGHEAVVKLLLQRGAVCDR

SEQ ID NO: 788 - protein, 32 aa, Artificial Sequence
  Description of Artificial Sequence: Synthetic segment of Q89540_1/1-32
CGRTPLHAYVQYDGVRPEVVALMLEAGADVVC

SEQ ID NO: 789 - protein, 31 aa, Artificial Sequence
  Description of Artificial Sequence: Synthetic segment of Q25338_5/1-31
NNWTPLHFAIYFKKEDAAKELLKQDDINLTI

SEQ ID NO: 790 - protein, 30 aa, Artificial Sequence
  Description of Artificial Sequence: Synthetic segment of O17055_3/1-30
HLLPALHLAAMIGDSEMLTILLNSGANIHV

SEQ ID NO: 791 - protein, 30 aa, Artificial Sequence
  Description of Artificial Sequence: Synthetic segment of O44872/1-30
LGRNALLIAIENENIEMIELLLDHNIETGD

SEQ ID NO: 792 - protein, 30 aa, Artificial Sequence
  Description of Artificial Sequence: Synthetic segment of 1790447/1-30
ARDTGLFMAMQRGHMNVINTIFNALPTLFN

SEQ ID NO: 793 - protein, 33 aa, Artificial Sequence
  Description of Artificial Sequence: Synthetic segment of HRG_COWPX_3/1-3
YIISHLYSESDSRSCVNPEVVKCLINHGINPSS

SEQ ID NO: 794 - protein, 30 aa, Artificial Sequence
  Description of Artificial Sequence: Synthetic segment of Q21587_2/1-30
EKPSPIDIAVLKDDPHLLKIVLDAGANPNA

SEQ ID NO: 795 - protein, 30 aa, Artificial Sequence
  Description of Artificial Sequence: Synthetic segment of VB18_VARV_2/1-3
EGKTLLHIACEYNNTHVIDYLIRINGDINA

SEQ ID NO: 796 - protein, 37 aa, Artificial Sequence
  Description of Artificial Sequence: Synthetic segment of VB04_VACCC_1/1-
  MOD_RES (13)..(17): Any amino acid
YGCTLLHRCIYHXXXXXSESYNELIKILLNNGSDVDK

SEQ ID NO: 797 - protein, 30 aa, Artificial Sequence
  Description of Artificial Sequence: Synthetic segment of O75407/1-30
LNSTPLHWATRQGHLSMVVQLMKYGADPSL

SEQ ID NO: 798 - protein, 31 aa, Artificial Sequence
  Description of Artificial Sequence: Synthetic segment of P87621_4/1-31
FGDSPLTLLIKTLSPAHLINKLLSTSNVITD

SEQ ID NO: 799 - protein, 31 aa, Artificial Sequence
  Description of Artificial Sequence: Synthetic segment of O54807_1/1-31
EGRTPVHVAISNQHSVIIQLLISHPNIELSV

SEQ ID NO: 800 - protein, 31 aa, Artificial Sequence
  Description of Artificial Sequence: Synthetic segment of FEM1_CAEEL_4/1-
QGVDPLMGAALSGFLDVLNVLADQMPSGIHK

SEQ ID NO: 801 - protein, 33 aa, Artificial Sequence
  Description of Artificial Sequence: Synthetic segment of Q84566/1-33
GYRSLLQYALSWGRHGNSKVIELLLKHGANVDY

SEQ ID NO: 802 - protein, 28 aa, Artificial Sequence
  Description of Artificial Sequence: Synthetic segment of Q27105_1/1-28
HGRTSLYWAVYYKNKEIVELLQSHGATI

SEQ ID NO: 803 - protein, 30 aa, Artificial Sequence
  Description of Artificial Sequence: Synthetic segment of O13075/1-30
NGDNVLHLSIIHLHRELVKNLLEVMPDMNY

SEQ ID NO: 804 - protein, 30 aa, Artificial Sequence
  Description of Artificial Sequence: Synthetic segment of G3930527_4/1-30
QRSTPLIIAARNGHAKVVRLLLEHYRVQTQ

SEQ ID NO: 805 - protein, 30 aa, Artificial Sequence
  Description of Artificial Sequence: Synthetic segment of G3925387_5/1-30
DGHSLLHWAALGGNADVCQILIENKINPNV

SEQ ID NO: 806 - protein, 30 aa, Artificial Sequence
  Description of Artificial Sequence: Synthetic segment of O88849_6/1-30
EGRTSFMWAAGKGNDDVLRTMLSLKSDIDI

SEQ ID NO: 807 - protein, 30 aa, Artificial Sequence
  Description of Artificial Sequence: Synthetic segment of O88849_7/1-30
QGATPLHYAAQSNFAETVKVFLQHPSVKDD

SEQ ID NO: 808 - protein, 30 aa, Artificial Sequence
  Description of Artificial Sequence: Synthetic segment of O17055_4/1-30
EGNQALHYAAKSGSLVILNMLIKQVRGTND

SEQ ID NO: 809 - protein, 30 aa, Artificial Sequence
  Description of Artificial Sequence: Synthetic segment of Q18297_5/1-30
NKMTPLLLACVHGSQEIIQELIKANSNVTK

SEQ ID NO: 810 - protein, 32 aa, Artificial Sequence
  Description of Artificial Sequence: Synthetic segment of FEM1_CAEEL_5/1-
NNDTPMHILLRAREFRKSLVRALLVRGTWLFA

SEQ ID NO: 811 - protein, 30 aa, Artificial Sequence
  Description of Artificial Sequence: Synthetic segment of O75762_4/1-30
DGCTPLHYACRQGGPGSVNNLLGFNVSIHS

SEQ ID NO: 812 - protein, 30 aa, Artificial Sequence
  Description of Artificial Sequence: Synthetic segment of O14586_1/1-30
SWATGLHLSVLFGHVECLLVLLDHNATINC

SEQ ID NO: 813 - protein, 30 aa, Artificial Sequence
  Description of Artificial Sequence: Synthetic segment of P90784/1-30
NGNTALHLCVIHDKMDMLDAVLEAGGNIRL

SEQ ID NO: 814 - protein, 30 aa, Artificial Sequence
  Description of Artificial Sequence: Synthetic segment of Q94527_1/1-30
DGDSALHVACQQDRAHYIRPLLGMGCNPNL

SEQ ID NO: 815 - protein, 31 aa, Artificial Sequence
  Description of Artificial Sequence: Synthetic segment of O54807_2/1-31
YLQTPLHMAIAYNHPDVVSVILEQKANALHA

SEQ ID NO: 816 - protein, 30 aa, Artificial Sequence
  Description of Artificial Sequence: Synthetic segment of O75762_5/1-30
NGWTALHHASMGGYTQTMKVILDTNLKCTD

SEQ ID NO: 817 - protein, 31 aa, Artificial Sequence
  Description of Artificial Sequence: Synthetic segment of 157038_1/1-31
DGDTPLHLACISGSVDVVAALIRMAPHPCLL

SEQ ID NO: 818 - protein, 30 aa, Artificial Sequence
  Description of Artificial Sequence: Synthetic segment of Q02989_4/1-30
NGNTLLHLFSSTGELEVVQFLMQNGANFRL

SEQ ID NO: 819 - protein, 32 aa, Artificial Sequence
  Description of Artificial Sequence: Synthetic segment of O60736_1/1-32
QGWTVLHEAVSTGDPEMVYTVLQHRDYHNTSM

SEQ ID NO: 820 - protein, 29 aa, Artificial Sequence
  Description of Artificial Sequence: Synthetic segment of ANK1_MOUSE_18/1
DGFTPLAVALQQGHENVVAHLINYGTKGK

SEQ ID NO: 821 - protein, 33 aa, Artificial Sequence
  Description of Artificial Sequence: Synthetic segment of O61222_1/1-33
YGRTPLMYAIMTNNRSVVDAIVGDGKLAVVLHK

SEQ ID NO: 822 - protein, 31 aa, Artificial Sequence
  Description of Artificial Sequence: Synthetic segment of Q62422/1-31
AGSTALYWACHGGHKDIVEVLFTQPNVELNQ

SEQ ID NO: 823 - protein, 30 aa, Artificial Sequence
  Description of Artificial Sequence: Synthetic segment of Q24241_15/1-30
NGLSALHMAAQGEHDEAAHLLLDNKAPVDE

SEQ ID NO: 824 - protein, 31 aa, Artificial Sequence
  Description of Artificial Sequence: Synthetic segment of YD57_SCHPO_2/1-
DKRTPLHWACSVGKVNTIYFLLKQPNIKPDE

SEQ ID NO: 825 - protein, 32 aa, Artificial Sequence
  Description of Artificial Sequence: Synthetic segment of G3927831_2/1-32
NRRTCLHYAAYYGHANCVQAILSAAQSSPVAV

SEQ ID NO: 826 - protein, 30 aa, Artificial Sequence
  Description of Artificial Sequence: Synthetic segment of P70770_1/1-30
DNNNALWFACFGNHYDLIHLLLAAKINIDN

SEQ ID NO: 827 - protein, 30 aa, Artificial Sequence
  Description of Artificial Sequence: Synthetic segment of Q94527_2/1-30
AGNTPLHVAVKEEHLSCVESFLNGVPTVQL

SEQ ID NO: 828 - protein, 30 aa, Artificial Sequence
  Description of Artificial Sequence: Synthetic segment of P72763_4/1-30
QGTTALEWAIKQQNLSMVRKLIEHHAPLDL

SEQ ID NO: 829 - protein, 30 aa, Artificial Sequence
  Description of Artificial Sequence: Synthetic segment of O60733_2/1-30
EGCTPLHLACRKGDGEILVELVQYCHTQMD

SEQ ID NO: 830 - protein, 30 aa, Artificial Sequence
  Description of Artificial Sequence: Synthetic segment of KBF1_MOUSE/1-30
KSYPQVKICNYVGPAKVIVQLVTNGKNIHL

SEQ ID NO: 831 - protein, 31 aa, Artificial Sequence
  Description of Artificial Sequence: Synthetic segment of O88849_9/1-31
ERYTPLDYALLGERHEVIQFMLEHGALSIAA

SEQ ID NO: 832 - protein, 30 aa, Artificial Sequence
  Description of Artificial Sequence: Synthetic segment of O82630_1/1-30
LGSTPLLEAIKNGNDRVAALLVKEGATLNI

SEQ ID NO: 833 - protein, 30 aa, Artificial Sequence
  Description of Artificial Sequence: Synthetic segment of YAHD_ECOLI/1-30
QGKTAITLASLYQQYACVQALIDAGADINK

SEQ ID NO: 834 - protein, 30 aa, Artificial Sequence
  Description of Artificial Sequence: Synthetic segment of Q84644_3/1-30
REEPILHVITSIGNVNMMKTMLDEGADINV

SEQ ID NO: 835 - protein, 30 aa, Artificial Sequence
  Description of Artificial Sequence: Synthetic segment of 157038_2/1-30
SGRTPLHIAIEGCNEDLANFLLDECEKLNL

SEQ ID NO: 836 - protein, 34 aa, Artificial Sequence
  Description of Artificial Sequence: Synthetic segment of 1790447_1/1-34
YGCPGLYLAMQNGHSDIVKVILEALPSLAQEINI

SEQ ID NO: 837 - protein, 31 aa, Artificial Sequence
  Description of Artificial Sequence: Synthetic segment of O75762_6/1-31
NMMAPLHIAVQGMNNEVMKVLLEHRTIDVNL

SEQ ID NO: 838 - protein, 30 aa, Artificial Sequence
  Description of Artificial Sequence: Synthetic segment of LI12_CAEEL_2/1-
DENTPLMLAVLARRRRLVAYLMKAGADPTI

SEQ ID NO: 839 - protein, 30 aa, Artificial Sequence
  Description of Artificial Sequence: Synthetic segment of G3970962_1/1-30
HGYTALMFAALSGNKDITWVMLEAGAETDV

SEQ ID NO: 840 - protein, 30 aa, Artificial Sequence
  Description of Artificial Sequence: Synthetic segment of VC09_VACCC_2/1-
QDLLLEYVSYHTVYINVIKCMIDEGATLYR

SEQ ID NO: 841 - protein, 31 aa, Artificial Sequence
  Description of Artificial Sequence: Synthetic segment of O83807_2/1-31
SGKTPWHWAVRALDRDLIKHLVTLGPPTQER

SEQ ID NO: 842 - protein, 30 aa, Artificial Sequence
  Description of Artificial Sequence: Synthetic segment of O23296/1-30
DGNTALYYAIEGRYLEMATCLVNADKDAPF

SEQ ID NO: 843 - protein, 30 aa, Artificial Sequence
  Description of Artificial Sequence: Synthetic segment of G3927831_3/1-30
DRHSVLHVAAANGQIEILSLLLERFTNPDL

SEQ ID NO: 844 - protein, 32 aa, Artificial Sequence
  Description of Artificial Sequence: Synthetic segment of YB07_FOWPM_3/1-
NGYSPIKMAVRLRDVEMIKLLMSYNTYPDYNY

SEQ ID NO: 845 - protein, 30 aa, Artificial Sequence
  Description of Artificial Sequence: Synthetic segment of RN5A_MOUSE_2/1-
NGFTAFMEAAERGNAEALRFLFAKGANVNL

SEQ ID NO: 846 - protein, 30 aa, Artificial Sequence
  Description of Artificial Sequence: Synthetic segment of O54910_1/1-30
HGDTALHVACRRQNLACACCLLEEQPEPGR

SEQ ID NO: 847 - protein, 32 aa, Artificial Sequence
  Description of Artificial Sequence: Synthetic segment of O44997_4/1-32
GGYEPMHTCYDHFVGNADCIHLILYRTSDPTE

SEQ ID NO: 848 - protein, 30 aa, Artificial Sequence
  Description of Artificial Sequence: Synthetic segment of O00306/1-30
REQTPLFLAAREGAVEVAQLLLGLGAAREL

SEQ ID NO: 849 - protein, 30 aa, Artificial Sequence
  Description of Artificial Sequence: Synthetic segment of O61222_2/1-30
SGNTAAHYAAAYGFLDCLKLLASIDDNILS

SEQ ID NO: 850 - protein, 30 aa, Artificial Sequence
  Description of Artificial Sequence: Synthetic segment of O74205/1-30
DQFSPLMTAISLGRLDIARILLQSGAPLDI

SEQ ID NO: 851 - protein, 32 aa, Artificial Sequence
  Description of Artificial Sequence: Synthetic segment of VB18_VARV_3/1-3
EYIKSRYMLLKEEDIDENIVSTLLDKGIDPNF

SEQ ID NO: 852 - protein, 33 aa, Artificial Sequence
  Description of Artificial Sequence: Synthetic segment of P87603_1/1-33
HLITPLHSYLRRDESISASVLKKVIELGADRNL

SEQ ID NO: 853 - protein, 30 aa, Artificial Sequence
  Description of Artificial Sequence: Synthetic segment of O82630_2/1-30
DHRTPLHVAASEGFYVLAIQLVEASANVLA

SEQ ID NO: 854 - protein, 30 aa, Artificial Sequence
  Description of Artificial Sequence: Synthetic segment of Q25328_4/1-30
KTDTPLCYASENGHFTVVQYLVSNGAKVNH

SEQ ID NO: 855 - protein, 30 aa, Artificial Sequence
  Description of Artificial Sequence: Synthetic segment of JC4356/1-30
AGQTAAMYAALFKRTEVLKELTDKGADLSI

SEQ ID NO: 856 - protein, 30 aa, Artificial Sequence
  Description of Artificial Sequence: Synthetic segment of O50999/1-30
NGNPIFTYAINVKAKSIINYLITKEFNINL

SEQ ID NO: 857 - protein, 30 aa, Artificial Sequence
  Description of Artificial Sequence: Synthetic segment of Q20109_3/1-30
YSSTALMLATRGNFIQVVELLLTREPNVNV

SEQ ID NO: 858 - protein, 33 aa, Artificial Sequence
  Description of Artificial Sequence: Synthetic segment of GLP1_CAEEL_2/1-
SERSALHEAVVNKDLRILRHLLTDKRLLKEIDE

SEQ ID NO: 859 - protein, 33 aa, Artificial Sequence
  Description of Artificial Sequence: Synthetic segment of Q86916_1/1-33
NNLSALAHYLSFNKNVEPEIVKILIDSGSSITE

SEQ ID NO: 860 - protein, 30 aa, Artificial Sequence
  Description of Artificial Sequence: Synthetic segment of Q92527_1/1-30
RYNTVLHYAVCGQSLSLVEKLLEYEADLEA

SEQ ID NO: 861 - protein, 30 aa, Artificial Sequence
  Description of Artificial Sequence: Synthetic segment of O90757_4/1-30
NDYRLLHSAITHENKKMIELLCLHGININV

SEQ ID NO: 862 - protein, 32 aa, Artificial Sequence
  Description of Artificial Sequence: Synthetic segment of I50404_2/1-32
YGNSLLHLALQAADEEMLRMLLAHLGSATPYL

SEQ ID NO: 863 - protein, 31 aa, Artificial Sequence
  Description of Artificial Sequence: Synthetic segment of Q94400_1/1-31
GGATALQYAVINGNEYLVEILTSHASIDVNI

SEQ ID NO: 864 - protein, 32 aa, Artificial Sequence
  Description of Artificial Sequence: Synthetic segment of Q83730/1-32
DGYGPVQTYIHSKNVVLDTLRELVRAGATVHD

SEQ ID NO: 865 - protein, 30 aa, Artificial Sequence
  Description of Artificial Sequence: Synthetic segment of O44997_5/1-30
NGDTPLHVACRFAQHTVAGYVANEKIDVDS

SEQ ID NO: 866 - protein, 30 aa, Artificial Sequence
  Description of Artificial Sequence: Synthetic segment of Q25338_6/1-30
NKYLPIHKAIINDDLDMVRLFLEKDPSLKD

SEQ ID NO: 867 - protein, 30 aa, Artificial Sequence
  Description of Artificial Sequence: Synthetic segment of O90760_3/1-30
TGLTPLDIAMSCNNYEIISLLVSHVIRLDY

SEQ ID NO: 868 - protein, 30 aa, Artificial Sequence
  Description of Artificial Sequence: Synthetic segment of 391941_1/1-30
NGHSPLFYALWESHVDVLNALLQRPLNLPS

SEQ ID NO: 869 - protein, 34 aa, Artificial Sequence
  Description of Artificial Sequence: Synthetic segment of 1790447_2/1-34
TSSHVLYHVMANGDADMLKIVLNALPLLIRTCHL

SEQ ID NO: 870 - protein, 30 aa, Artificial Sequence
  Description of Artificial Sequence: Synthetic segment of Q02979_2/1-30
YKRTPLHYSCQYGLSEVTKLIIKLMKEWNI

SEQ ID NO: 871 - protein, 30 aa, Artificial Sequence
  Description of Artificial Sequence: Synthetic segment of O74205_1/1-30
EGNSLLHIAVKTNSLSITRLLLERYKSCRE

SEQ ID NO: 872 - protein, 32 aa, Artificial Sequence
  Description of Artificial Sequence: Synthetic segment of Q86916_2/1-32
LYETPLFSCVEKDKVNVEILNFLIENGSDINF

SEQ ID NO: 873 - protein, 31 aa, Artificial Sequence
  Description of Artificial Sequence: Synthetic segment of Q94527_3/1-31
DGNNALHMAVLEQSVELLVLILDAQNENLTD

SEQ ID NO: 874 - protein, 30 aa, Artificial Sequence
  Description of Artificial Sequence: Synthetic segment of O15084_16/1-30
NWQTPLHIAAANKAVKCAEALVPLLSNVNV

SEQ ID NO: 875 - protein, 30 aa, Artificial Sequence
  Description of Artificial Sequence: Synthetic segment of YG4X_YEAST_1/1-
DGRIPLHWSVSFQAHEITSFLLSKMENVNL

SEQ ID NO: 876 - protein, 30 aa, Artificial Sequence
  Description of Artificial Sequence: Synthetic segment of O18270_5/1-30
NGYTALHLAAMVGHEKVCKILTNQPTSIFP

SEQ ID NO: 877 - protein, 30 aa, Artificial Sequence
  Description of Artificial Sequence: Synthetic segment of Q14349_4/1-30
QQRTPLMEAVVNNHLEVARYMVQRGGCVYS

SEQ ID NO: 878 - protein, 34 aa, Artificial Sequence
  Description of Artificial Sequence: Synthetic segment of JQ1744_2/1-34
KFHTPLHTYVDKNSKGVAPSIIQYMIDRGVSTAR

SEQ ID NO: 879 - protein, 32 aa, Artificial Sequence
  Description of Artificial Sequence: Synthetic segment of PLU_DROME/1-32
FGQNALTLATYAGHLTLVKELLRRRSYKDFNL

SEQ ID NO: 880 - protein, 31 aa, Artificial Sequence
  Description of Artificial Sequence: Synthetic segment of O54807_4/1-31
NGNNALHLAVMHGRLNNIRALLTECTVDAEA

SEQ ID NO: 881 - protein, 30 aa, Artificial Sequence
  Description of Artificial Sequence: Synthetic segment of O15084_17/1-30
ATISPLHLAAYHGHHQALEVLVQSLLDLDV

SEQ ID NO: 882 - protein, 30 aa, Artificial Sequence
  Description of Artificial Sequence: Synthetic segment of Q93203_1/1-30
PAIYPFHLAAKYNHVECMQALREHGFSINY

SEQ ID NO: 883 - protein, 31 aa, Artificial Sequence
  Description of Artificial Sequence: Synthetic segment of O88849_11/1-31
EGRTPLHFAVADGNLTVVDVLTSYESCNITS

SEQ ID NO: 884 - protein, 30 aa, Artificial Sequence
  Description of Artificial Sequence: Synthetic segment of Q17643/1-30
AMMNTLHMAVAHKQRDIVELLLKNGYDPNT

SEQ ID NO: 885 - protein, 30 aa, Artificial Sequence
  Description of Artificial Sequence: Synthetic segment of O48738_2/1-30
DEASPLYMAVEAGYHELVLKMLESSSSPSI

SEQ ID NO: 886 - protein, 30 aa, Artificial Sequence
  Description of Artificial Sequence: Synthetic segment of 1790447_3/1-30
QKYSAFELAFEFGHRVIAELILNTLNKMAE

SEQ ID NO: 887 - protein, 31 aa, Artificial Sequence
  Description of Artificial Sequence: Synthetic segment of Q02989_9/1-31
SECNPLHEAAAYAHLDLVKYFVQERGINPAE

SEQ ID NO: 888 - protein, 31 aa, Artificial Sequence
  Description of Artificial Sequence: Synthetic segment of Q19995_1/1-31
FGCTPLHSAVVHEHTEIVRYIAGHYNSVLNA

SEQ ID NO: 889 - protein, 30 aa, Artificial Sequence
  Description of Artificial Sequence: Synthetic segment of O90760_4/1-30
DRNSLLLVATKRNYIDVVRYLVKKGVDINF

SEQ ID NO: 890 - protein, 31 aa, Artificial Sequence
  Description of Artificial Sequence: Synthetic segment of Q89340_5/1-31
SGCTPLHRAVFNGHDACASMLVNKIVSERPL

SEQ ID NO: 891 - protein, 31 aa, Artificial Sequence
  Description of Artificial Sequence: Synthetic segment of O90757_5/1-31
NKYSMLHFLSTSNKYHNVMAVLLDKGIDVNI

SEQ ID NO: 892 - protein, 30 aa, Artificial Sequence
  Description of Artificial Sequence: Synthetic segment of Q20313_1/1-30
QDSDIFLSACMSGDEEEVEELLNKGANINT

SEQ ID NO: 893 - protein, 29 aa, Artificial Sequence
  Description of Artificial Sequence: Synthetic segment of Q89202_2/1-29
KGNTALYYAVDSGNMQTVKLFVKKNWRLM

SEQ ID NO: 894 - protein, 30 aa, Artificial Sequence
  Description of Artificial Sequence: Synthetic segment of YMV8_YEAST_2/1-
KGNTCVHLALMKGHEQTLHLLLQQFPRFIN

SEQ ID NO: 895 - protein, 30 aa, Artificial Sequence
  Description of Artificial Sequence: Synthetic segment of 157038_3/1-30
VAQTPLHLAALTAQPNIMRILLLAGAEPTV

SEQ ID NO: 896 - protein, 35 aa, Artificial Sequence
  Description of Artificial Sequence: Synthetic segment of AKR1_YEAST_2/1-
QGFNLLHLSVNSSNIMLVLYVLFNVVSKGLLDIDC

SEQ ID NO: 897 - protein, 30 aa, Artificial Sequence
  Description of Artificial Sequence: Synthetic segment of Q18297_6/1-30
REKELIHFAAEKGFLEVLKALVEAGGNKNE

SEQ ID NO: 898 - protein, 30 aa, Artificial Sequence
  Description of Artificial Sequence: Synthetic segment of O68219/1-30
DGRTIIHYAAKDGNLEILQQALGRKSSYSK

SEQ ID NO: 899 - protein, 30 aa, Artificial Sequence
  Description of Artificial Sequence: Synthetic segment of Q20109_5/1-30
FGNWILTSAVRSGNAAIVRMILDKFADINC

SEQ ID NO: 900 - protein, 30 aa, Artificial Sequence
  Description of Artificial Sequence: Synthetic segment of Q25328_7/1-30
DGMNFFYYAVQNGHLNIVKYAMSEKDKFEW

SEQ ID NO: 901 - protein, 30 aa, Artificial Sequence
  Description of Artificial Sequence: Synthetic segment of O61222_4/1-30
EDNTPLHYALTNGNLMLFNLMLDKVANKRN

SEQ ID NO: 902 - protein, 30 aa, Artificial Sequence
  Description of Artificial Sequence: Synthetic segment of Q21587_5/1-30
LLKSALHFALLSGNHDLVKFMIANGSNVNM

SEQ ID NO: 903 - protein, 30 aa, Artificial Sequence
  Description of Artificial Sequence: Synthetic segment of O61222_5/1-30
KKRTPLIHAMLNGQIHTAAFLLAKGASLTL

SEQ ID NO: 904 - protein, 30 aa, Artificial Sequence
  Description of Artificial Sequence: Synthetic segment of Q21920_13/1-30
RKISPMMAAFRKGHVEIVKYMVNSAKQFPN

SEQ ID NO: 905 - protein, 30 aa, Artificial Sequence
  Description of Artificial Sequence: Synthetic segment of Q83730_1/1-30
LGNSCLDLAVLNGNKYMVHRLLRKTITPDA

SEQ ID NO: 906 - protein, 30 aa, Artificial Sequence
  Description of Artificial Sequence: Synthetic segment of Q18297_7/1-30
DTKTVLHTAAFYGNESIVRYFIAEGVTIDR

SEQ ID NO: 907 - protein, 31 aa, Artificial Sequence
  Description of Artificial Sequence: Synthetic segment of Q18663_1/1-31
EEFTPLHNAVKMGNTVMAKNFIDSKSVWIDE

SEQ ID NO: 908 - protein, 31 aa, Artificial Sequence
  Description of Artificial Sequence: Synthetic segment of Q25328_8/1-31
GLLSALHYAILYKHDDVASFLMRSSNVNVNL

SEQ ID NO: 909 - protein, 30 aa, Artificial Sequence
  Description of Artificial Sequence: Synthetic segment of O18152_4/1-30
YGQHPMMIAAANGNLKVLEYLMGISDIINQ

SEQ ID NO: 910 - protein, 30 aa, Artificial Sequence
  Description of Artificial Sequence: Synthetic segment of O54807_6/1-30
HRQTALHLAAQQDLPTICSVLLENGVDFAA

SEQ ID NO: 911 - protein, 30 aa, Artificial Sequence
  Description of Artificial Sequence: Synthetic segment of O73630_3/1-30
NGDTPLHLAVIHGQSSVIEQLVQIILSIPN

SEQ ID NO: 912 - protein, 30 aa, Artificial Sequence
  Description of Artificial Sequence: Synthetic segment of 35040_3/1-30
RGHTPLDLTCSTLVKTLLLNAAQNTMEPPL

SEQ ID NO: 913 - protein, 33 aa, Artificial Sequence
  Description of Artificial Sequence: Synthetic segment of Q19995_2/1-33
DGRTPLHHAYMKRRNELIEYLLYICPDSANIKD

SEQ ID NO: 914 - protein, 33 aa, Artificial Sequence
  Description of Artificial Sequence: Synthetic segment of DAPK_HUMAN_3/1-
DADIRLWVNGCKLANRGAELLVLLVNHGQGIEV

SEQ ID NO: 915 - protein, 30 aa, Artificial Sequence
  Description of Artificial Sequence: Synthetic segment of Q25328_9/1-30
KGLAPLLAFSKKGNLDMVKYLFDKNANVYI

SEQ ID NO: 916 - protein, 33 aa, Artificial Sequence
  Description of Artificial Sequence: Synthetic segment of O43150_1/1-33
PDETALHLAVRSVDRTSLHIVDFLVQNSGNLDK

SEQ ID NO: 917 - protein, 30 aa, Artificial Sequence
  Description of Artificial Sequence: Synthetic segment of YAR1_YEAST_1/1-
SDSTALHMAAANGHIETVRYILETVSRANS

SEQ ID NO: 918 - protein, 31 aa, Artificial Sequence
  Description of Artificial Sequence: Synthetic segment of Q84566_2/1-31
NGHTLLLWSAEKSKNMELVKYLIHAGVEISQ

SEQ ID NO: 919 - protein, 30 aa, Artificial Sequence
  Description of Artificial Sequence: Synthetic segment of S57237/1-30
YGKSPINDAAENQQVECLNVLVQHGTSVDY

SEQ ID NO: 920 - protein, 33 aa, Artificial Sequence
  Description of Artificial Sequence: Synthetic segment of 35040_4/1-33
NGDTPLHLAIIHGQTSVIEQIVYVIHHAQDLGV

SEQ ID NO: 921 - protein, 30 aa, Artificial Sequence
  Description of Artificial Sequence: Synthetic segment of Q18587_1/1-30
NGRTAIQIAADYGQTSIIAYLISIGANIQD

SEQ ID NO: 922 - protein, 30 aa, Artificial Sequence
  Description of Artificial Sequence: Synthetic segment of Q02989_10/1-30
QENTPITVAIFANKVSILNYLVGIGADPNQ

SEQ ID NO: 923 - protein, 32 aa, Artificial Sequence
  Description of Artificial Sequence: Synthetic segment of Q09493_1/1-32
IGLTPLYYNMLTADSNDQVAEILLREAADIGV

SEQ ID NO: 924 - protein, 30 aa, Artificial Sequence
  Description of Artificial Sequence: Synthetic segment of O15084_18/1-30
RGRTPIHLSAACGHIGVLGALLQSAASMDA

SEQ ID NO: 925 - protein, 33 aa, Artificial Sequence
  Description of Artificial Sequence: Synthetic segment of Q21920_15/1-33
KKNTPLMEACAGDQGDQAGVVKLLLSKHAEVDV

SEQ ID NO: 926 - protein, 30 aa, Artificial Sequence
  Description of Artificial Sequence: Synthetic segment of O83807_6/1-30
DGSTPLHVMAKRGYTGFVQFLVDRKVNLNA

SEQ ID NO: 927 - protein, 30 aa, Artificial Sequence
  Description of Artificial Sequence: Synthetic segment of D1037943_4/1-30
YDATAMHRAAAKGNLKMVHILLFYKASTNI

SEQ ID NO: 928 - protein, 30 aa, Artificial Sequence
  Description of Artificial Sequence: Synthetic segment of YB07_FOWPM_4/1-
DIESELHEAVEEGDVVKVEELLDSGKFIND

SEQ ID NO: 929 - protein, 30 aa, Artificial Sequence
  Description of Artificial Sequence: Synthetic segment of O45398_1/1-30
DDRTALDIAVEKRDLKSARICIKGGADVNA

SEQ ID NO: 930 - protein, 30 aa, Artificial Sequence
  Description of Artificial Sequence: Synthetic segment of O49409_1/1-30
DGGVRLMYLANEGDIEGIKELIDSGIDANY

SEQ ID NO: 931 - protein, 30 aa, Artificial Sequence
  Description of Artificial Sequence: Synthetic segment of O83807_8/1-30
KGETPLVLTIDRDHRDLTAYFVSLGADIHA

SEQ ID NO: 932 - protein, 31 aa, Artificial Sequence
  Description of Artificial Sequence: Synthetic segment of S57237_1/1-31
NDVTPVYLAAQEGHLEVLKFLVLEAGGSLYV

SEQ ID NO: 933 - protein, 30 aa, Artificial Sequence
  Description of Artificial Sequence: Synthetic segment of JQ1744_3/1-30
YGFTPLLSAVYAVNLNFFNHFVKLGADINV

SEQ ID NO: 934 - protein, 30 aa, Artificial Sequence
  Description of Artificial Sequence: Synthetic segment of E1350345_1/1-30
NGRSCLFYARSNGFREVFDMLVTAGLSPDY

SEQ ID NO: 935 - protein, 35 aa, Artificial Sequence
  Description of Artificial Sequence: Synthetic segment of P87611_1/1-35
IGKTALYYYIITRSRDKLSLDVINCLISYEKEILY

SEQ ID NO: 936 - protein, 30 aa, Artificial Sequence
  Description of Artificial Sequence: Synthetic segment of Q23595_2/1-30
RGQSLLHIACLCGHEHIVRWILNRSGSDAI

SEQ ID NO: 937 - protein, 30 aa, Artificial Sequence
  Description of Artificial Sequence: Synthetic segment of P90902_2/1-30
DFWQPVHAAACWAQPDLIELLCQYGGDIHA

SEQ ID NO: 938 - protein, 36 aa, Artificial Sequence
  Description of Artificial Sequence: Synthetic segment of VC17_VACCC_1/1-
  MOD_RES (13)..(16): Any amino acid
MCKNSLHYYISSXXXXQSLSKDVIKCLINNNVSIHG

SEQ ID NO: 939 - protein, 32 aa, Artificial Sequence
  Description of Artificial Sequence: Synthetic segment of JQ1744_4/1-32
HGNSSLHYYMRRYMLCKSVLDILLSTGVDING

SEQ ID NO: 940 - protein, 30 aa, Artificial Sequence
  Description of Artificial Sequence: Synthetic segment of Q93203_2/1-30
KNILPIHLAAWNGNLEIVKMLLLQTMEKPA

SEQ ID NO: 941 - protein, 30 aa, Artificial Sequence
  Description of Artificial Sequence: Synthetic segment of O45398_2/1-30
EERTPLICAVMANNHIMCETLIRSGVNCDV

SEQ ID NO: 942 - protein, 31 aa, Artificial Sequence
  Description of Artificial Sequence: Synthetic segment of O00522_1/1-31
DHWAPIHYACWYGKVEATRILLEKGKCNPNL

SEQ ID NO: 943 - protein, 30 aa, Artificial Sequence
  Description of Artificial Sequence: Synthetic segment of Q02989_11/1-30
SGFTPLHLSISSTSETAAILIRNTNAVINI

SEQ ID NO: 944 - protein, 30 aa, Artificial Sequence
  Description of Artificial Sequence: Synthetic segment of YMV8_YEAST_3/1-
NGWSSLHYASYHGRYLICVYLIQLGHDKHE

SEQ ID NO: 945 - protein, 35 aa, Artificial Sequence
  Description of Artificial Sequence: Synthetic segment of Q07045_4/1-35
NSNILQHILIEYMTFDDIDIHLVECMLAYGAVVNK

SEQ ID NO: 946 - protein, 30 aa, Artificial Sequence
  Description of Artificial Sequence: Synthetic segment of O15084_20/1-30
DGKTPLHMTALHGRFSRSQTIIQSGAVIDC

SEQ ID NO: 947 - protein, 30 aa, Artificial Sequence
  Description of Artificial Sequence: Synthetic segment of Q18297_8/1-30
YQLTPLHYAAMKSNFSALHALIKLKADVDA

SEQ ID NO: 948 - protein, 32 aa, Artificial Sequence
  Description of Artificial Sequence: Synthetic segment of O24538_2/1-32
NGNTALWYAIASKHYSIFRILYQLSALSDPYT

SEQ ID NO: 949 - protein, 30 aa, Artificial Sequence
  Description of Artificial Sequence: Synthetic segment of O55014_3/1-30
LLSTALHVAVRTGHYECAEHLIACEADLNA

SEQ ID NO: 950 - protein, 33 aa, Artificial Sequence
  Description of Artificial Sequence: Synthetic segment of O45398_3/1-33
QGASALEIALCSEHEKSRQIAAQLVEKGADVNV

SEQ ID NO: 951 - protein, 30 aa, Artificial Sequence
  Description of Artificial Sequence: Synthetic segment of O17055_5/1-30
VHFTALHCATYFGQENAVRTLISASANLNL

SEQ ID NO: 952 - protein, 30 aa, Artificial Sequence
  Description of Artificial Sequence: Synthetic segment of O15084_21/1-30
LKRTPIHAAATNGHSECLRLLIGNAEPQNA

SEQ ID NO: 953 - protein, 33 aa, Artificial Sequence
  Description of Artificial Sequence: Synthetic segment of O88849_14/1-33
EGKIPLHWAANHKDPSAVHTVRCILDAAPTESL

SEQ ID NO: 954 - protein, 30 aa, Artificial Sequence
  Description of Artificial Sequence: Synthetic segment of Q02989_13/1-30
RNEYPFYLAVEKRYKDIFDYFVSKDANVNE

SEQ ID NO: 955 - protein, 30 aa, Artificial Sequence
  Description of Artificial Sequence: Synthetic segment of O23295_1/1-30
YGVSSLFVAINTGDVSLVKAILKIIGNKDL

SEQ ID NO: 956 - protein, 30 aa, Artificial Sequence
  Description of Artificial Sequence: Synthetic segment of Q14349_5/1-30
EENICLHWASFTGSAAIAEVLLNARCDLHA

SEQ ID NO: 957 - protein, 30 aa, Artificial Sequence
  Description of Artificial Sequence: Synthetic segment of Q12013_1/1-30
RGFNALHCALVGGDQRVICDLILSGANFYE

SEQ ID NO: 958 - protein, 30 aa, Artificial Sequence
  Description of Artificial Sequence: Synthetic segment of Q40785_2/1-30
DDESIVHHTASVGDAEGLKKALDGGADKDE

SEQ ID NO: 959 - protein, 30 aa, Artificial Sequence
  Description of Artificial Sequence: Synthetic segment of DAPK_HUMAN_5/1-
GGSNAVYWAARHGHVDTLKFLSENKCPLDV

SEQ ID NO: 960 - protein, 34 aa, Artificial Sequence
  Description of Artificial Sequence: Synthetic segment of O18270_6/1-34
RDRSPLHYAACKVNLEALRILLFVDPNGGPDFGF

SEQ ID NO: 961 - protein, 30 aa, Artificial Sequence
  Description of Artificial Sequence: Synthetic segment of Q86916_3/1-30
RYCNPLFYYVEQDDINGVKKWIKFVNDCND

SEQ ID NO: 962 - protein, 30 aa, Artificial Sequence
  Description of Artificial Sequence: Synthetic segment of AKR_ARATH_2/1-3
GGLTALHRAIIGKKQAITNYLLRESANPFV

SEQ ID NO: 963 - protein, 31 aa, Artificial Sequence
  Description of Artificial Sequence: Synthetic segment of O16004_2/1-31
MGETPLHAAVRADAIEVFRLLIQNRSTQIDA

SEQ ID NO: 964 - protein, 41 aa, Artificial Sequence
  Description of Artificial Sequence: Synthetic segment of O16004_3/1-41
  MOD_RES (13)..(22): Any amino acid
DGLTPLMLAVMRXXXXXXXXXXETHAHFIEDLITRGGDINH

SEQ ID NO: 965 - protein, 30 aa, Artificial Sequence
  Description of Artificial Sequence: Synthetic segment of YA2A_SCHPO_4/1-
QGFNCLHLAVHAASPLLVVYLLHLDISVDL

SEQ ID NO: 966 - protein, 30 aa, Artificial Sequence
  Description of Artificial Sequence: Synthetic segment of Q18297_9/1-30
EKKTPLRMAVEGNHPETLKKILQMEKKNSC

SEQ ID NO: 967 - protein, 31 aa, Artificial Sequence
  Description of Artificial Sequence: Synthetic segment of O35433_1/1-31
KGLTPLALAASSGKIGVLAYILQREIHEPEC

SEQ ID NO: 968 - protein, 30 aa, Artificial Sequence
  Description of Artificial Sequence: Synthetic segment of O54807_8/1-30
KGNPPLWLALASNLEDIASTLVRHGCDATC

SEQ ID NO: 969 - protein, 40 aa, Artificial Sequence
  Description of Artificial Sequence: Synthetic segment of P87603_3/1-40
  MOD_RES (13)..(20): Any amino acid
TYLSRLCIVNKNXXXXXXXXNNINIEVVKYLIRSGSDISL

SEQ ID NO: 970 - protein, 30 aa, Artificial Sequence
  Description of Artificial Sequence: Synthetic segment of O73579_3/1-30
SLPIQYYWSCSTIDIEIVKLLIKDVDTCRV

SEQ ID NO: 971 - protein, 33 aa, Artificial Sequence
  Description of Artificial Sequence: Synthetic segment of Q21587_6/1-33
RLKSPFVEYFRSNDSIDAKVVKLFITHGAKVVM

SEQ ID NO: 972 - protein, 30 aa, Artificial Sequence
  Description of Artificial Sequence: Synthetic segment of A53950_3/1-30
FDKSAFDIAMEKNNTEILVMLQEAMQNQVN

SEQ ID NO: 973 - protein, 31 aa, Artificial Sequence
  Description of Artificial Sequence: Synthetic segment of Q18663_3/1-31
SGRTPFDLACEYGQEKMLERLFSCGLRKINF

SEQ ID NO: 974 - protein, 31 aa, Artificial Sequence
  Description of Artificial Sequence: Synthetic segment of Q25328_11/1-31
NNITALHYAAILGYLETTKQLINLKEINANV

SEQ ID NO: 975 - protein, 36 aa, Artificial Sequence
  Description of Artificial Sequence: Synthetic segment of O72760_2/1-36
  MOD_RES (13)..(16): Any amino acid
EYKNILIHYIYSXXXXKPINYYVLYKLLRKGADPNY

SEQ ID NO: 976 - protein, 30 aa, Artificial Sequence
  Description of Artificial Sequence: Synthetic segment of Q89342_2/1-30
DGSTPLHFIARWGRKICARELITAGVEINT

SEQ ID NO: 977 - protein, 30 aa, Artificial Sequence
  Description of Artificial Sequence: Synthetic segment of O83807_9/1-30
MGSSALVLAIKKDRSDLCHELLALGADLFI

SEQ ID NO: 978 - protein, 33 aa, Artificial Sequence
  Description of Artificial Sequence: Synthetic segment of Q83730_2/1-33
DGRYPLLCLLENDRINTARFVRYMIDRGTSVYV

SEQ ID NO: 979 - protein, 32 aa, Artificial Sequence
  Description of Artificial Sequence: Synthetic segment of O04242_3/1-32
RLDLPVTLCFAVNKGDDFMLHQLLKRGLDPNE

SEQ ID NO: 980 - protein, 30 aa, Artificial Sequence
  Description of Artificial Sequence: Synthetic segment of O82490_1/1-30
YGLSPLHLAIEEGQTRLVLSLLKVDSDLVR

SEQ ID NO: 981 - protein, 30 aa, Artificial Sequence
  Description of Artificial Sequence: Synthetic segment of O45398_4/1-30
DQFTPAHMAVSWAQNDVLRALRDHSANLCD

SEQ ID NO: 982 - protein, 35 aa, Artificial Sequence
  Description of Artificial Sequence: Synthetic segment of P87600_4/1-35
NGVDPLMLTMENNMLSGHQWYLVKNILDKRPNVNM

SEQ ID NO: 983 - protein, 48 aa, Artificial Sequence
  Description of Artificial Sequence: Synthetic segment of O73560_2/1-48
  MOD_RES (13)..(29): Any amino acid
DGLTSLHYYCKHXXXXXXXXXXXXXXXXXRAEKRFIYTIIDHGANINA

SEQ ID NO: 984 - protein, 33 aa, Artificial Sequence
  Description of Artificial Sequence: Synthetic segment of P87603_5/1-33
NIPEILYLYIQMAQYVDLDVIKHFLNNSVILDY

SEQ ID NO: 985 - protein, 29 aa, Artificial Sequence
  Description of Artificial Sequence: Synthetic segment of Q14678_3/1-29
DGSTALSIALEAGHKDIAVLLYAHVNFAK

SEQ ID NO: 986 - protein, 38 aa, Artificial Sequence
  Description of Artificial Sequence: Synthetic segment of Q93318_1/1-38
  MOD_RES (13)..(18): Any amino acid
HGDTAVDLLCSSXXXXXXNNVRENLYIRLLTSGAVPNK

SEQ ID NO: 987 - protein, 30 aa, Artificial Sequence
  Description of Artificial Sequence: Synthetic segment of G3930525_6/1-30
YGMTPLLAASVTGHTNIVEYLIQEQPGHEQ

SEQ ID NO: 988 - protein, 33 aa, Artificial Sequence
  Description of Artificial Sequence: Synthetic segment of YB07_FOWPM_5/1-
SKRPCVTAMCYAIQNNKIDMVSMFLKRGADSNI

SEQ ID NO: 989 - protein, 31 aa, Artificial Sequence
  Description of Artificial Sequence: Synthetic segment of JQ1744_5/1-31
FGDTCVTLAVATNHVYFVTAVLQHKPSEQTI

SEQ ID NO: 990 - protein, 31 aa, Artificial Sequence
  Description of Artificial Sequence: Synthetic segment of VB04_VACCC_2/1-
YGENILHIYSMDDANTNIIIFFLDRVLNINK

SEQ ID NO: 991 - protein, 35 aa, Artificial Sequence
  Description of Artificial Sequence: Synthetic segment of O41154_3/1-35
  MOD_RES (28)..(31): Any amino acid
YGKTCIEMAAYYGHQDILKMMNGKLGIXXXXIIND

SEQ ID NO: 992 - protein, 36 aa, Artificial Sequence
  Description of Artificial Sequence: Synthetic segment of P87600_5/1-36
GDMDILYTYFNSPRTRCIKLDLIKYMVDVGIVNLNY

SEQ ID NO: 993 - protein, 31 aa, Artificial Sequence
  Description of Artificial Sequence: Synthetic segment of Q21920_17/1-31
DGVNCFMEVARHGSIDLMSLLVEFTKGNMPM

SEQ ID NO: 994 - protein, 30 aa, Artificial Sequence
  Description of Artificial Sequence: Synthetic segment of O44997_6/1-30
NGATAMHCAAKYGHAEVFNYFHMKGGNICA

SEQ ID NO: 995 - protein, 30 aa, Artificial Sequence
  Description of Artificial Sequence: Synthetic segment of P72763_6/1-30
EGKTPLMLAAMANLAAVITTIANYSVQVNR

SEQ ID NO: 996 - protein, 31 aa, Artificial Sequence
  Description of Artificial Sequence: Synthetic segment of Q09493_2/1-31
QGETPLTLAAGIPNNRAVIVSLIGGGAHVDF

SEQ ID NO: 997 - protein, 30 aa, Artificial Sequence
  Description of Artificial Sequence: Synthetic segment of Q24145_1/1-30
FGCQPLHYAARSKTASFIRTLISAQANVQG

SEQ ID NO: 998 - protein, 31 aa, Artificial Sequence
  Description of Artificial Sequence: Synthetic segment of Q17583_2/1-31
NGVSPLMYATTVRSINSAKHLVLHRDSDVNM

SEQ ID NO: 999 - protein, 30 aa, Artificial Sequence
  Description of Artificial Sequence: Synthetic segment of O90757_6/1-30
HVKAPIHVAVERNNIYGTMLLINRNADVNI

SEQ ID NO: 1000 - protein, 30 aa, Artificial Sequence
  Description of Artificial Sequence: Synthetic segment of MBP1_YEAST_1/1-
ELHTAFHWACSMGNLPIAEALYEAGTSIRS

SEQ ID NO: 1001 - protein, 30 aa, Artificial Sequence
  Description of Artificial Sequence: Synthetic segment of O83807_10/1-30
GGNTPLHLACEWKLTQAINGILRKGAEIEA

SEQ ID NO: 1002 - protein, 32 aa, Artificial Sequence
  Description of Artificial Sequence: Synthetic segment of G4103857_2/1-32
GLLTPLHLAAGNRDSRDTLELLLMNRYIKPEL

SEQ ID NO: 1003 - protein, 30 aa, Artificial Sequence
  Description of Artificial Sequence: Synthetic segment of O18270_7/1-30
ESVTPLHIAATKQDTKILKIFVEILKTPKV

SEQ ID NO: 1004 - protein, 31 aa, Artificial Sequence
  Description of Artificial Sequence: Synthetic segment of O68219_2/1-31
GKKTTLTAEALTSGKYGVVKALIKNSADVNA

SEQ ID NO: 1005 - protein, 30 aa, Artificial Sequence
  Description of Artificial Sequence: Synthetic segment of Q19995_4/1-30
TGSVALILAVLNGHKSIVEAILGYSLNTLN

SEQ ID NO: 1006 - protein, 29 aa, Artificial Sequence
  Description of Artificial Sequence: Synthetic segment of O45398_5/1-29
DGRTPAHIGVREQNVDGVKILLDAENVEF

SEQ ID NO: 1007 - protein, 30 aa, Artificial Sequence
  Description of Artificial Sequence: Synthetic segment of Q12013_3/1-30
NNRTPLLWAAYQGDFLTVELLLKFGSTVAW

SEQ ID NO: 1008 - protein, 31 aa, Artificial Sequence
  Description of Artificial Sequence: Synthetic segment of O18152_5/1-31
MGQTPLMLAASQGQLEAVQFLTKTAKADVDA

SEQ ID NO: 1009 - protein, 32 aa, Artificial Sequence
  Description of Artificial Sequence: Synthetic segment of Q89540_4/1-32
YGRTTLHHLARTAKISEGMVRTLTGLGVDPAA

SEQ ID NO: 1010 - protein, 30 aa, Artificial Sequence
  Description of Artificial Sequence: Synthetic segment of Q17643_1/1-30
VDQTPLGVAVRSQSSELIALLIAYGGDVNL

SEQ ID NO: 1011 - protein, 31 aa, Artificial Sequence
  Description of Artificial Sequence: Synthetic segment of Q63618_3/1-31
DGMTPLHAAAQMGHNPVLVWLVSFADVSFEQ

SEQ ID NO: 1012 - protein, 30 aa, Artificial Sequence
  Description of Artificial Sequence: Synthetic segment of O14586_2/1-30
DFKSPLHKAAWNCDHVLMHMMLEAGAEANL

SEQ ID NO: 1013 - protein, 31 aa, Artificial Sequence
  Description of Artificial Sequence: Synthetic segment of Q17583_4/1-31
GNLTALSMAIVCTPGVYMVRTLIDLGASVNK

SEQ ID NO: 1014 - protein, 32 aa, Artificial Sequence
  Description of Artificial Sequence: Synthetic segment of O68219_3/1-32
TGTPALHLATAAGNHRTAMLLLDKGAPATQRD

SEQ ID NO: 1015 - protein, 31 aa, Artificial Sequence
  Description of Artificial Sequence: Synthetic segment of Q93318_2/1-31
DGDTPLHIVAAHNDLGKIYALCETLRKTMNE

SEQ ID NO: 1016 - protein, 30 aa, Artificial Sequence
  Description of Artificial Sequence: Synthetic segment of O54807_9/1-30
DGETALQLAIKHQLPLVVDAICTRGADMSV

SEQ ID NO: 1017 - protein, 30 aa, Artificial Sequence
  Description of Artificial Sequence: Synthetic segment of Q01317_4/1-30
DNFTPLVHSIVRNHLECVGRLLERSARIDP

SEQ ID NO: 1018 - protein, 30 aa, Artificial Sequence
  Description of Artificial Sequence: Synthetic segment of O82490_2/1-30
FINTPLHIASASGNLSFAMELMNLKPSFAR

SEQ ID NO: 1019 - protein, 30 aa, Artificial Sequence
  Description of Artificial Sequence: Synthetic segment of YAHD_ECOLI_2/1-
TCLNPFLISCLNDDLTLLRIILPAKPDLNC

SEQ ID NO: 1020 - protein, 30 aa, Artificial Sequence
  Description of Artificial Sequence: Synthetic segment of Q63618_4/1-30
LDALPVHHAARSGKLHCLRYLVEEVALPAV

SEQ ID NO: 1021 - protein, 44 aa, Artificial Sequence
  Description of Artificial Sequence: Synthetic segment of Q89440_2/1-44
  MOD_RES (13)..(25): Any amino acid
MEMYPRHRYSKHXXXXXXXXXXXXXDLDMNVVKELLSNGASLTI

SEQ ID NO: 1022 - protein, 38 aa, Artificial Sequence
  Description of Artificial Sequence: Synthetic segment of P87601_1/1-38
  MOD_RES (13)..(18): Any amino acid
DGYTCLDVAVDRXXXXXXREAHLKILEILLREPLSIDC

SEQ ID NO: 1023 - protein, 31 aa, Artificial Sequence
  Description of Artificial Sequence: Synthetic segment of O18152_8/1-31
HGRTCVHVVASTNDVAAAKMLKRIGGVNFEA

SEQ ID NO: 1024 - protein, 30 aa, Artificial Sequence
  Description of Artificial Sequence: Synthetic segment of 1AP7_1/1-30
TGSLPIHLAIREGHSSVVSFLAPESDLHHR

SEQ ID NO: 1025 - protein, 32 aa, Artificial Sequence
  Description of Artificial Sequence: Synthetic segment of O17055_6/1-32
FSETPLHAACTGGKSIELVSFLMKYPGVDPNY

SEQ ID NO: 1026 - protein, 32 aa, Artificial Sequence
  Description of Artificial Sequence: Synthetic segment of Q18297_10/1-32
RLNTVFHIVALRGEPEYLEMMMDHDPVEAIKA

SEQ ID NO: 1027 - protein, 32 aa, Artificial Sequence
  Description of Artificial Sequence: Synthetic segment of 157038_4/1-32
HGNTALHLSCIAGEKQCVRALTEKFGATEIHE

SEQ ID NO: 1028 - protein, 30 aa, Artificial Sequence
  Description of Artificial Sequence: Synthetic segment of O75762_9/1-30
DKKSPLHFAASYGRINTCQRLLQDISDTRL

SEQ ID NO: 1029 - protein, 31 aa, Artificial Sequence
  Description of Artificial Sequence: Synthetic segment of O23296_4/1-31
TGDSILHIAAKWGHLELVKEIIFECPCLLFE

SEQ ID NO: 1030 - protein, 30 aa, Artificial Sequence
  Description of Artificial Sequence: Synthetic segment of TRI9_HUMAN_3/1-
DGDTALHLAVIHQHEPFLDFLLGFSAGTEY

SEQ ID NO: 1031 - protein, 32 aa, Artificial Sequence
  Description of Artificial Sequence: Synthetic segment of Q23595_3/1-32
NGETAAHISAAHGDMRALEILLGGSLKSTMNC

SEQ ID NO: 1032 - protein, 32 aa, Artificial Sequence
  Description of Artificial Sequence: Synthetic segment of VC17_VACCC_2/1-
GGSLPIQYYWSFSTIDIEIVKLLLIKDVDTCR

SEQ ID NO: 1033 - protein, 30 aa, Artificial Sequence
  Description of Artificial Sequence: Synthetic segment of Q18297_11/1-30
YQKTPLQVAVDSGKLETCQRLVAKGAQIES

SEQ ID NO: 1034 - protein, 31 aa, Artificial Sequence
  Description of Artificial Sequence: Synthetic segment of NTC4_MOUSE_4/1-
AGRTPLHTAVAADAREVCQLLLASRQTSVDA

SEQ ID NO: 1035 - protein, 30 aa, Artificial Sequence
  Description of Artificial Sequence: Synthetic segment of O54807_10/1-30
KGRNFLHVAVQNSDIESVLFLISVQANVNS

SEQ ID NO: 1036 - protein, 31 aa, Artificial Sequence
  Description of Artificial Sequence: Synthetic segment of O68219_4/1-31
MGDTALHEALYSDNVTEKCFLKMLKESRKHL

SEQ ID NO: 1037 - protein, 32 aa, Artificial Sequence
  Description of Artificial Sequence: Synthetic segment of O18270_8/1-32
VGRTAVFWACMGGQAHTLHCMIKELGFEWRTS

SEQ ID NO: 1038 - protein, 31 aa, Artificial Sequence
  Description of Artificial Sequence: Synthetic segment of O18152_9/1-31
DGAVALHYAVTHDHVELVKHLTNQHTVEAKD

SEQ ID NO: 1039 - protein, 30 aa, Artificial Sequence
  Description of Artificial Sequence: Synthetic segment of Q18297_12/1-30
DERTPVFIGAKFNALSSVEYILDHLRKKNK

SEQ ID NO: 1040 - protein, 34 aa, Artificial Sequence
  Description of Artificial Sequence: Synthetic segment of VC09_VACCC_4/1-
DGETPLKAYVTKKNNNIKNDVVILLLSSVDYKNI

SEQ ID NO: 1041 - protein, 29 aa, Artificial Sequence
  Description of Artificial Sequence: Synthetic segment of 1AP7_2/1-29
FGKTALQVMMFGSPAVALELLKQGASPNV

SEQ ID NO: 1042 - protein, 35 aa, Artificial Sequence
  Description of Artificial Sequence: Synthetic segment of P87600_6/1-35
LGYTPLTSYICTAQNYMYYDIIDCLISNKVLNMVK

SEQ ID NO: 1043 - protein, 30 aa, Artificial Sequence
  Description of Artificial Sequence: Synthetic segment of O75762_10/1-30
CHETMLHRASLFDHHELADYLISVGADINK

SEQ ID NO: 1044 - protein, 35 aa, Artificial Sequence
  Description of Artificial Sequence: Synthetic segment of P87603_6/1-35
YSSNIFSVYFKAHNTIGIDIKLVKWMITKGVDINY

SEQ ID NO: 1045 - protein, 30 aa, Artificial Sequence
  Description of Artificial Sequence: Synthetic segment of O48738_5/1-30
MGETTLHVAARAGSLNIVEILVRFITESSS

SEQ ID NO: 1046 - protein, 30 aa, Artificial Sequence
  Description of Artificial Sequence: Synthetic segment of P87611_2/1-30
DFDIFEYIESDNIDVELLRLLIAKGLEINS

SEQ ID NO: 1047 - protein, 31 aa, Artificial Sequence
  Description of Artificial Sequence: Synthetic segment of Q25328_13/1-31
RGTTPFLTAVAENALHIAEYLIREKRQDINI

SEQ ID NO: 1048 - protein, 31 aa, Artificial Sequence
  Description of Artificial Sequence: Synthetic segment of Q02979_3/1-31
KSSSLLHLATEWNNYPLLHVLLSSKRFDINY

SEQ ID NO: 1049 - protein, 30 aa, Artificial Sequence
  Description of Artificial Sequence: Synthetic segment of Q01317_5/1-30
KDLPAMYYAAWEGHLECMKLLTPAKKEKAA

SEQ ID NO: 1050 - protein, 30 aa, Artificial Sequence
  Description of Artificial Sequence: Synthetic segment of Q17343_21/1-30
EGDEPEHHYTETTTTTVTKEVIDDSQEMGD

SEQ ID NO: 1051 - protein, 31 aa, Artificial Sequence
  Description of Artificial Sequence: Synthetic segment of Q19995_6/1-31
DKIDGIHKSIKEGNLDKVKELMKTKKLAIAR

SEQ ID NO: 1052 - protein, 30 aa, Artificial Sequence
  Description of Artificial Sequence: Synthetic segment of P90902_3/1-30
DGSTYLHVASANGYYDVAAFLLTCSVSPLI

SEQ ID NO: 1053 - protein, 34 aa, Artificial Sequence
  Description of Artificial Sequence: Synthetic segment of O68219_5/1-34
YEPHPQHVAVEAVRTGAVGVLEHLITTEVISVNE

SEQ ID NO: 1054 - protein, 30 aa, Artificial Sequence
  Description of Artificial Sequence: Synthetic segment of Q83730_3/1-30
LDFTPINYCVIHNDRRTFDYLLERGADPNV

SEQ ID NO: 1055 - protein, 30 aa, Artificial Sequence
  Description of Artificial Sequence: Synthetic segment of E1344043_2/1-30
FGYNALVCAVKAKAMDCIIAIRDAGGFIDA

SEQ ID NO: 1056 - protein, 31 aa, Artificial Sequence
  Description of Artificial Sequence: Synthetic segment of O45398_8/1-31
YGENAMLCAVRSGSLDCIRAVADSSRTNRYA

SEQ ID NO: 1057 - protein, 31 aa, Artificial Sequence
  Description of Artificial Sequence: Synthetic segment of Q12013_4/1-31
YVVDIFIEAAKDGDLKVVKDVVESGAVDINN

SEQ ID NO: 1058 - protein, 31 aa, Artificial Sequence
  Description of Artificial Sequence: Synthetic segment of O24382_4/1-31
GDVGHFACVAVEQNNLSLLKEIVRYGGDVTL

SEQ ID NO: 1059 - protein, 30 aa, Artificial Sequence
  Description of Artificial Sequence: Synthetic segment of 4151809_3/1-30
DGMTALHKAACARHCLALTALLDLGGSPNY

SEQ ID NO: 1060 - protein, 36 aa, Artificial Sequence
  Description of Artificial Sequence: Synthetic segment of O73579_4/1-36
  MOD_RES (13)..(16): Any amino acid
DESIVQAMLINYXXXXDMVSIPIVRCMLDNGATMDK

SEQ ID NO: 1061 - protein, 32 aa, Artificial Sequence
  Description of Artificial Sequence: Synthetic segment of O15084_23/1-32
NAFSPLHCAVINDNEGAAEMLIDTLGASIVNA

SEQ ID NO: 1062 - protein, 31 aa, Artificial Sequence
  Description of Artificial Sequence: Synthetic segment of Q20109_8/1-31
NGESLLTVAVRSGNTAVAKQLAQLDPDAIDE

SEQ ID NO: 1063 - protein, 33 aa, Artificial Sequence
  Description of Artificial Sequence: Synthetic segment of O04703_2/1-33
IRTSSLIEAMKSRQEDNVTMMKNFLQHHKKLKD

SEQ ID NO: 1064 - protein, 31 aa, Artificial Sequence
  Description of Artificial Sequence: Synthetic segment of Q18970_1/1-31
SGMTPAMMCAKRSFTMFPLRLIVRAGADLSL

SEQ ID NO: 1065 - protein, 30 aa, Artificial Sequence
  Description of Artificial Sequence: Synthetic segment of Q18663_4/1-30
DGISACHIACKDGMIDHFNLLIYYHADICL

SEQ ID NO: 1066 - protein, 40 aa, Artificial Sequence
  Description of Artificial Sequence: Synthetic segment of O72755_3/1-40
  MOD_RES (13)..(19): Any amino acid
DGMIPVVYCIHSXXXXXXXNITNIKIIRKLLNLSRHAPHN

SEQ ID NO: 1067 - protein, 30 aa, Artificial Sequence
  Description of Artificial Sequence: Synthetic segment of Q25338_10/1-30
NDRSAMHAVAYRGNNKIALRFLLKNQSIDI

SEQ ID NO: 1068 - protein, 30 aa, Artificial Sequence
  Description of Artificial Sequence: Synthetic segment of O54807_12/1-30
EGNTVLLLAYMKGNANLCRAIVRSGVRLGV

SEQ ID NO: 1069 - protein, 30 aa, Artificial Sequence
  Description of Artificial Sequence: Synthetic segment of O45398_10/1-30
RGQTACHVAAEAGAPEILSKIVEARRGLKW

SEQ ID NO: 1070 - protein, 31 aa, Artificial Sequence
  Description of Artificial Sequence: Synthetic segment of Q21920_18/1-31
NCNTALIYAASTDGRDVVREILMTEGPKKPD

SEQ ID NO: 1071 - protein, 29 aa, Artificial Sequence
  Description of Artificial Sequence: Synthetic segment of Q21587_7/1-29
QLRNVLKLAALQNQPEVLELLLGLGEQYD

SEQ ID NO: 1072 - protein, 33 aa, Artificial Sequence
  Description of Artificial Sequence: Synthetic segment of VC09_VACCC_5/1-
NGINIVEKYATTSNPNVDVFKLLLDKGIPTCSN

SEQ ID NO: 1073 - protein, 35 aa, Artificial Sequence
  Description of Artificial Sequence: Synthetic segment of VC17_VACCC_3/1-
  MOD_RES (28)..(31): Any amino acid
SNINDFDLSSDNIDLRLLKYLIVDKRIXXXXNTNY

SEQ ID NO: 1074 - protein, 30 aa, Artificial Sequence
  Description of Artificial Sequence: Synthetic segment of VB04_VACCC_3/1-
SGCTCISEAVANNNKIIMEVLLSKRPSLKI

SEQ ID NO: 1075 - protein, 33 aa, Artificial Sequence
  Description of Artificial Sequence: Synthetic segment of Q18970_2/1-33
QGYTPIHLAIQGNHVPLVAYFLLKFEYAKDISD

SEQ ID NO: 1076 - protein, 30 aa, Artificial Sequence
  Description of Artificial Sequence: Synthetic segment of Q23859_3/1-30
NGFSALHQAVSSDDRILMRGLQYENINVDV

SEQ ID NO: 1077 - protein, 30 aa, Artificial Sequence
  Description of Artificial Sequence: Synthetic segment of Q25328_14/1-30
YDKTALDIAIDAKFSNIVEYLKTKSGKFRR

SEQ ID NO: 1078 - protein, 30 aa, Artificial Sequence
  Description of Artificial Sequence: Synthetic segment of Q19995_7/1-30
YGMTPIHKALLHGQTNTVRFLLGRFPSCVN

SEQ ID NO: 1079 - protein, 30 aa, Artificial Sequence
  Description of Artificial Sequence: Synthetic segment of VB04_VACCC_4/1-
YNETSIYDAVSYNAYNTLVYLLNRNGDFET

SEQ ID NO: 1080 - protein, 31 aa, Artificial Sequence
  Description of Artificial Sequence: Synthetic segment of O88202_1/1-31
VLLPGLALAAAHAGDLDTLQAFVELGRDLNL

SEQ ID NO: 1081 - protein, 30 aa, Artificial Sequence
  Description of Artificial Sequence: Synthetic segment of E1350208_1/1-30
ELPNPLHEAARRGNMDMLAECLRERVSVNS

SEQ ID NO: 1082 - protein, 32 aa, Artificial Sequence
  Description of Artificial Sequence: Synthetic segment of O54807_13/1-32
ALYSPKKYSADVMSEMAQIAEALLQAGANPNM

SEQ ID NO: 1083 - protein, 34 aa, Artificial Sequence
  Description of Artificial Sequence: Synthetic segment of Q23859_4/1-34
QQQHQLFSAVEQNDVTKVKKLSSKKKISKSNLTS

SEQ ID NO: 1084 - protein, 31 aa, Artificial Sequence
  Description of Artificial Sequence: Synthetic segment of O04242_4/1-31
GDVALYSCVAVEENDPELLENIIRYGGNVNS

SEQ ID NO: 1085 - protein, 30 aa, Artificial Sequence
  Description of Artificial Sequence: Synthetic segment of Q93203_3/1-30
SDFTLLHHAVLENQNQISKLLMDYEPLLLL

SEQ ID NO: 1086 - protein, 30 aa, Artificial Sequence
  Description of Artificial Sequence: Synthetic segment of Q17583_5/1-30
LHITSLQIASLLRVDDIIPLLLQRRADVTV

SEQ ID NO: 1087 - protein, 30 aa, Artificial Sequence
  Description of Artificial Sequence: Synthetic segment of YIA1_YEAST_1/1-
KNFEELCYSCRTGDMDNVDRLISTGVNVNS

SEQ ID NO: 1088 - protein, 30 aa, Artificial Sequence
  Description of Artificial Sequence: Synthetic segment of O35433_2/1-30
FGELPLSLAACTNQLAIVKFLLQNSWQPAD

SEQ ID NO: 1089 - protein, 30 aa, Artificial Sequence
  Description of Artificial Sequence: Synthetic segment of O83515_2/1-30
CFEENFIATVMDGNIDIVNLFLDAGFSAAL

SEQ ID NO: 1090 - protein, 30 aa, Artificial Sequence
  Description of Artificial Sequence: Synthetic segment of O23295_4/1-30
NGWTCLSLAAHIGYYEGVCNLLERSTKAAE

SEQ ID NO: 1091 - protein, 30 aa, Artificial Sequence
  Description of Artificial Sequence: Synthetic segment of AKR_ARATH_3/1-3
KKWLPLHTLAACGEFYLVDSLLKHNLDINA

SEQ ID NO: 1092 - protein, 35 aa, Artificial Sequence
  Description of Artificial Sequence: Synthetic segment of Q83730_4/1-35
SRTSPLCTVLSNKDLGNEAEALAKQLIDAGADVNA

SEQ ID NO: 1093 - protein, 43 aa, Artificial Sequence
  Description of Artificial Sequence: Synthetic segment of O72760_5/1-43
  MOD_RES (13)..(24): Any amino acid
RGNTFLHYFCIYXXXXXXXXXXXXHREKKFIKELVKYGADINK

SEQ ID NO: 1094 - protein, 32 aa, Artificial Sequence
  Description of Artificial Sequence: Synthetic segment of Q63618_7/1-32
NGATPAHDAAATGYLSCLQWLLTQGGCRVQEK

SEQ ID NO: 1095 - protein, 31 aa, Artificial Sequence
  Description of Artificial Sequence: Synthetic segment of YG4X_YEAST_4/1-
FNQIPLHRAASVGSLKLIELLCGLGKSAVNW

SEQ ID NO: 1096 - protein, 34 aa, Artificial Sequence
  Description of Artificial Sequence: Synthetic segment of G3786431_4/1-34
EGSTCLHWAARCGSSECVSTILNFPFPSEFIIEI

SEQ ID NO: 1097 - protein, 32 aa, Artificial Sequence
  Description of Artificial Sequence: Synthetic segment of O73579_5/1-32
EGLTPLGAYSKHRHVKYQIVHLLISSYSNSSN

SEQ ID NO: 1098 - protein, 32 aa, Artificial Sequence
  Description of Artificial Sequence: Synthetic segment of Q01317_6/1-32
ERVTRTFLASINEGSLEALKVLLDTGLVDIQS

SEQ ID NO: 1099 - protein, 33 aa, Artificial Sequence
  Description of Artificial Sequence: Synthetic segment of O73579_6/1-33
DNNYPLHDYFVNNNLVDVNVVRFIVENNGHMAV

SEQ ID NO: 1100 - protein, 31 aa, Artificial Sequence
  Description of Artificial Sequence: Synthetic segment of O83807_13/1-31
NQETPLFSAVKSDAAEVISILLHPQAGNPAL

SEQ ID NO: 1101 - protein, 33 aa, Artificial Sequence
  Description of Artificial Sequence: Synthetic segment of LI12_CAEEL_4/1-
SERSALHQAAANRDFGMMVYMLNSTKLKGDIEE

SEQ ID NO: 1102 - protein, 30 aa, Artificial Sequence
  Description of Artificial Sequence: Synthetic segment of Q89202_3/1-30
LFIPDNKLAIDNKDIEMLQALFKYDINIYS

SEQ ID NO: 1103 - protein, 34 aa, Artificial Sequence
  Description of Artificial Sequence: Synthetic segment of Q24241_22/1-34
DGNTALHIASNLGYVTVMESLKIVTSTSVINSNI

SEQ ID NO: 1104 - protein, 31 aa, Artificial Sequence
  Description of Artificial Sequence: Synthetic segment of Q93318_4/1-31
VGDSPLHFATARGMNNMVEALLSKREIRVNE

SEQ ID NO: 1105 - protein, 32 aa, Artificial Sequence
  Description of Artificial Sequence: Synthetic segment of Q25328_17/1-32
HGRTVFHAAAKSGNDKIMFGLTFLAKSTELNQ

SEQ ID NO: 1106 - protein, 30 aa, Artificial Sequence
  Description of Artificial Sequence: Synthetic segment of P70770_2/1-30
MAIVALMKATREGVDAVVKELIDLGVDQAR

SEQ ID NO: 1107 - protein, 38 aa, Artificial Sequence
  Description of Artificial Sequence: Synthetic segment of VB04_VACCC_5/1-
  MOD_RES (13)..(16): Any amino acid
HGISLIKLYLESXXXXEIDNEHIVRHLIIFDAVESLDY

SEQ ID NO: 1108 - protein, 34 aa, Artificial Sequence
  Description of Artificial Sequence: Synthetic segment of VB04_VACCC_6/1-
YGNTPFILLCKHDINNVELFEICLENANIDSVDF

SEQ ID NO: 1109 - protein, 34 aa, Artificial Sequence
  Description of Artificial Sequence: Synthetic segment of O04704_2/1-34
YGDPNMYVNLLTVASTGNATFLEELLKAKLDPDI

SEQ ID NO: 1110 - protein, 31 aa, Artificial Sequence
  Description of Artificial Sequence: Synthetic segment of O45398_12/1-31
DSKTPFFNEIVSRKDVASVEALLAANVDCHV

SEQ ID NO: 1111 - protein, 36 aa, Artificial Sequence
  Description of Artificial Sequence: Synthetic segment of TRPL_DROME_2/1-
  MOD_RES (13)..(16): Any amino acid
KSYTRFWGLLMFXXXXVINVIVLLNLLIAMMSNSYA

SEQ ID NO: 1112 - protein, 32 aa, Artificial Sequence
  Description of Artificial Sequence: Synthetic segment of JQ1744_6/1-32
YKRQVVEDYLRKRYVKADVLKTILDSGIRLSK

SEQ ID NO: 1113 - protein, 31 aa, Artificial Sequence
  Description of Artificial Sequence: Synthetic segment of Q84566_5/1-31
IRHNILFYHVIRDNYDVVKFIIDNKLVDINE

SEQ ID NO: 1114 - protein, 30 aa, Artificial Sequence
  Description of Artificial Sequence: Synthetic segment of O49409_2/1-30
WGSTPFADAIFYKNIDVIKILEIHGAKHPM

SEQ ID NO: 1115 - protein, 35 aa, Artificial Sequence
  Description of Artificial Sequence: Synthetic segment of JQ1744_7/1-35
SGHSAMMSYLINNPDATVHPEYVSYMVDCGANINQ

SEQ ID NO: 1116 - protein, 30 aa, Artificial Sequence
  Description of Artificial Sequence: Synthetic segment of Q02979_4/1-30
GGWTPMEHAVLRGHLHIADMVQIRDELVTH

SEQ ID NO: 1117 - protein, 27 aa, Artificial Sequence
  Description of Artificial Sequence: Synthetic segment of O24538_3/1-27
NLLCLAAKRNDLTVMNELLKQGLNIDS

SEQ ID NO: 1118 - protein, 30 aa, Artificial Sequence
  Description of Artificial Sequence: Synthetic segment of Q89202_4/1-30
GWKTSFYHAVMLNDVSIVSYFLSEIPSTFD

SEQ ID NO: 1119 - protein, 30 aa, Artificial Sequence
  Description of Artificial Sequence: Synthetic segment of O83807_14/1-30
SGSTPLMVAVTENCFESVRMLIARDASLFS

SEQ ID NO: 1120 - protein, 31 aa, Artificial Sequence
  Description of Artificial Sequence: Synthetic segment of G3786431_5/1-31
ECRTAMYLAVAEGHLEVVKAMTDFKCTSIDG

SEQ ID NO: 1121 - protein, 27 aa, Artificial Sequence
  Description of Artificial Sequence: Synthetic segment of O62398_2/1-27
TGNTVIHCAINKKCLILLMEKFRDQTD

SEQ ID NO: 1122 - protein, 30 aa, Artificial Sequence
  Description of Artificial Sequence: Synthetic segment of Q25338_11/1-30
NHMAPIHFAASMGSIKMLRYLISIKDKVSI

SEQ ID NO: 1123 - protein, 31 aa, Artificial Sequence
  Description of Artificial Sequence: Synthetic segment of Q23595_4/1-31
CKMLPVHVAAAQGNIEFLRAAIKFDNQMVNA

SEQ ID NO: 1124 - protein, 30 aa, Artificial Sequence
  Description of Artificial Sequence: Synthetic segment of Q25328_18/1-30
NGQMPIHGAAMTGLLDVAQAIISIDATVVD

SEQ ID NO: 1125 - protein, 31 aa, Artificial Sequence
  Description of Artificial Sequence: Synthetic segment of Q28282_5/1-31
KYDDRLMKAAERGDVEKVSSILAKKGINPGK

SEQ ID NO: 1126 - protein, 29 aa, Artificial Sequence
  Description of Artificial Sequence: Synthetic segment of Q94527_4/1-29
NRDTLLHEVISHKKDKLKLAIQTIQVMNY

SEQ ID NO: 1127 - protein, 31 aa, Artificial Sequence
  Description of Artificial Sequence: Synthetic segment of AKR1_YEAST_5/1-
PLLTRYHTACQRGDLATVKEMIHGKLLEVNN

SEQ ID NO: 1128 - protein, 31 aa, Artificial Sequence
  Description of Artificial Sequence: Synthetic segment of 391941_4/1-31
SSDLDLHLTLDDIDEKIIHQRLQENKAAFFF

SEQ ID NO: 1129 - protein, 30 aa, Artificial Sequence
  Description of Artificial Sequence: Synthetic segment of Q23595_5/1-30
DRANAIHCAAYSGSVPVLSHLLNAFSKKKR

SEQ ID NO: 1130 - protein, 29 aa, Artificial Sequence
  Description of Artificial Sequence: Synthetic segment of P87603_8/1-29
SGMTAFHVAVCLRKDAMKYLLSIGYSIDK

SEQ ID NO: 1131 - protein, 42 aa, Artificial Sequence
  Description of Artificial Sequence: Synthetic segment of O72755_4/1-42
  MOD_RES (13)..(23): Any amino acid
QMRTPLHKYLCKXXXXXXXXXXXYYNEKIIDAFIELGADLTI

SEQ ID NO: 1132 - protein, 31 aa, Artificial Sequence
  Description of Artificial Sequence: Synthetic segment of O18270_9/1-31
IGATPAHYAAQFSVECLKILFAESKITEVND

SEQ ID NO: 1133 - protein, 31 aa, Artificial Sequence
  Description of Artificial Sequence: Synthetic segment of Q90623_5/1-31
EGDTPLDIAEEEAMEELLQNEVNRQGVDIEA

SEQ ID NO: 1134 - protein, 30 aa, Artificial Sequence
  Description of Artificial Sequence: Synthetic segment of O61222_7/1-30
QTETPLHVAARAGRAVNCTFLMKEMLDLEK

SEQ ID NO: 1135 - protein, 33 aa, Artificial Sequence
  Description of Artificial Sequence: Synthetic segment of JQ1744_9/1-33
RGHTPLLVYITMGLFIESDAITCMIDHGADPLV

SEQ ID NO: 1136 - protein, 32 aa, Artificial Sequence
  Description of Artificial Sequence: Synthetic segment of P87621_5/1-32
NNYHILHAYCGIKGLDERFVEELLHIGYSPNE

SEQ ID NO: 1137 - protein, 32 aa, Artificial Sequence
  Description of Artificial Sequence: Synthetic segment of O16229_1/1-32
DGKNAILDAVRERNKPNLLKALQNGAFVDVYN

SEQ ID NO: 1138 - protein, 35 aa, Artificial Sequence
  Description of Artificial Sequence: Synthetic segment of VB18_VARV_5/1-3
NNKHAIQLIIDNKENSQYTIDCLLYILRYIVDKNV

SEQ ID NO: 1139 - protein, 30 aa, Artificial Sequence
  Description of Artificial Sequence: Synthetic segment of O90757_7/1-30
KHFNMLRKAVLNHDHNLVNIFIDKNFNINI

SEQ ID NO: 1140 - protein, 32 aa, Artificial Sequence
  Description of Artificial Sequence: Synthetic segment of Q93318_5/1-32
TGKTIVHHAVDKMDVELLDFLKTVVNEDTFTE

SEQ ID NO: 1141 - protein, 31 aa, Artificial Sequence
  Description of Artificial Sequence: Synthetic segment of Q21920_19/1-31
ERDSALTLSAQKGHIKIVTAIMDYYEKNPPQ

SEQ ID NO: 1142 - protein, 31 aa, Artificial Sequence
  Description of Artificial Sequence: Synthetic segment of Q02989_18/1-31
ERKTFFDLAIENGRLNIVAFAVEKNKVNLQA

SEQ ID NO: 1143 - protein, 31 aa, Artificial Sequence
  Description of Artificial Sequence: Synthetic segment of A55839_4/1-31
GGRTPLGSALLRPNPILARLLRAHGAPEPED

SEQ ID NO: 1144 - protein, 31 aa, Artificial Sequence
  Description of Artificial Sequence: Synthetic segment of O60733_5/1-31
KGETVFHYAVQGDNSQVLQLLGRNAVAGLNQ

SEQ ID NO: 1145 - protein, 31 aa, Artificial Sequence
  Description of Artificial Sequence: Synthetic segment of O83807_16/1-31
AGESILHYAAKVADEKTLQGLLAMNRFGKFL

SEQ ID NO: 1146 - protein, 30 aa, Artificial Sequence
  Description of Artificial Sequence: Synthetic segment of O75762_11/1-30
QQASFLHLALHNKRKEVVLTIIRSKRWDEC

SEQ ID NO: 1147 - protein, 30 aa, Artificial Sequence
  Description of Artificial Sequence: Synthetic segment of 391941_5/1-30
VQFDPLNVACKFNNHDAAKLLLEIRSKQNA

SEQ ID NO: 1148 - protein, 30 aa, Artificial Sequence
  Description of Artificial Sequence: Synthetic segment of Q94447_2/1-30
KSFTRFWALLMFGSYSVINIIVLLNMLIAM

SEQ ID NO: 1149 - protein, 33 aa, Artificial Sequence
  Description of Artificial Sequence: Synthetic segment of Q18104_2/1-33
TIFEVLAWCNETVKQNDFDVMETALDSLNNLNL

SEQ ID NO: 1150 - protein, 31 aa, Artificial Sequence
  Description of Artificial Sequence: Synthetic segment of O48738_6/1-31
SGKSVIHAAMKANRRDILGIVLRQDPGLIEL

SEQ ID NO: 1151 - protein, 46 aa, Artificial Sequence
  Description of Artificial Sequence: Synthetic segment of O61222_8/1-46
  MOD_RES (13)..(25): Any amino acid
FNRTALHYAFGNXXXXXXXXXXXXXSDPIAVVSLLSSLIRPEQIEI

SEQ ID NO: 1152 - protein, 30 aa, Artificial Sequence
  Description of Artificial Sequence: Synthetic segment of O73579_8/1-30
RFNNCGYHCYETILIDVFDILSKYMDDIDM

SEQ ID NO: 1153 - protein, 31 aa, Artificial Sequence
  Description of Artificial Sequence: Synthetic segment of O23296_6/1-31
QGNKHLAHVALKAKSIGVLDVILDEYPSLMD

SEQ ID NO: 1154 - protein, 30 aa, Artificial Sequence
  Description of Artificial Sequence: Synthetic segment of Q09493_4/1-30
HGNHEIHQACKNGLTKHVEHLLYFGGQIDA

SEQ ID NO: 1155 - protein, 34 aa, Artificial Sequence
  Description of Artificial Sequence: Synthetic segment of Q83730_5/1-34
YGFNVLQCYMIAHVRSSNVQILRFLLRHGVDSSR

SEQ ID NO: 1156 - protein, 34 aa, Artificial Sequence
  Description of Artificial Sequence: Synthetic segment of Q91974_4/1-34
DGDTFLHLAIIHEEKALSLEVIRQAAGDAAFLNF

SEQ ID NO: 1157 - protein, 32 aa, Artificial Sequence
  Description of Artificial Sequence: Synthetic segment of O61240_6/1-32
MDRLPRDIANERLHTDIVQLLDEYNLVRSPNL

SEQ ID NO: 1158 - protein, 41 aa, Artificial Sequence
  Description of Artificial Sequence: Synthetic segment of IMO2HUMANb
PNDKIQAVIDAGVCRRLVELLMHNDYKVVSPALRAVGNIVT

SEQ ID NO: 1159 - protein, 41 aa, Artificial Sequence; identical to SEQ ID NO: 1158
  Description of Artificial Sequence: Synthetic segment of MMU34228c

SEQ ID NO: 1160 - protein, 41 aa, Artificial Sequence
  Description of Artificial Sequence: Synthetic segment of cATAF00130
SNDKIQAVIEAGVVPRLIQLLGHSSPSVLIPALRTIGNIVT

SEQ ID NO: 1161 - protein, 41 aa, Artificial Sequence; identical to SEQ ID NO: 1160
  Description of Artificial Sequence: Synthetic segment of cATKAPAPRO

SEQ ID NO: 1162 - protein, 41 aa, Artificial Sequence
  Description of Artificial Sequence: Synthetic segment of ATU69533d
TNDKIQTVIQAGVVPKLVELLLHHSPSVLIPALRTVGNIVT

SEQ ID NO: 1163 - protein, 41 aa, Artificial Sequence
  Description of Artificial Sequence: Synthetic segment of AB002533c
GNEQIQMVIDSGIVPHLVPLLSHQEVKVQTAALRAVGNIVT

SEQ ID NO: 1164 - protein, 41 aa, Artificial Sequence; identical to SEQ ID NO: 1163
  Description of Artificial Sequence: Synthetic segment of HSSRP11a

SEQ ID NO: 1165 - protein, 41 aa, Artificial Sequence
  Description of Artificial Sequence: Synthetic segment of HSSRP1Bc
GNEQIQMVIDSGVVPFLVPLLSHQEVKVQTAALRAVGNIVT

SEQ ID NO: 1166 - protein, 41 aa, Artificial Sequence
  Description of Artificial Sequence: Synthetic segment of CELF32E10c
GNEHIQMVIEAQVVTHLVPLLGHVDVKVQTAALRAVGNIVT

SEQ ID NO: 1167 - protein, 41 aa, Artificial Sequence
  Description of Artificial Sequence: Synthetic segment of SRP1YEASTd
PQEAIQAVIDVRIPKRLVELLSHESTLVQTPALRAVGNIVT

SEQ ID NO: 1168 - protein, 41 aa, Artificial Sequence
  Description of Artificial Sequence: Synthetic segment of IMO1HUMANc
PNERIGMVVKTGVVPQLVKLLGASELPIVTPALRAIGNIVT

SEQ ID NO: 1169 - protein, 41 aa, Artificial Sequence
  Description of Artificial Sequence: Synthetic segment of bATAF00130
TSENTNVIIESGAVPIFIQLLSSASEDVREQAVWALGNVAG

SEQ ID NO: 1170 - protein, 41 aa, Artificial Sequence; identical to SEQ ID NO: 1169
  Description of Artificial Sequence: Synthetic segment of bATKAPAPRO

SEQ ID NO: 1171 - protein, 41 aa, Artificial Sequence
  Description of Artificial Sequence: Synthetic segment of SLU96718b
TSDHTAVVIEQGAVPIFVQLLSSPSDDVREQAVWALGNVAG

SEQ ID NO: 1172 - protein, 41 aa, Artificial Sequence
  Description of Artificial Sequence: Synthetic segment of ATU69533b
TSDHTKVVIDHNAVPIFVQLLASPSDDVREQAVWALGNVAG

SEQ ID NO: 1173 - protein, 41 aa, Artificial Sequence
  Description of Artificial Sequence: Synthetic segment of IMO2HUMANc
NSLQTRIVIQARAVPIFIELLSSEFEDVQEQAVWALGNIAG

SEQ ID NO: 1174 - protein, 41 aa, Artificial Sequence
  Description of Artificial Sequence: Synthetic segment of MMU34228a
NSLQTRNVIQAGAVPIFIELLSSEFEDVQEQAVWALGNIAG

SEQ ID NO: 1175 - protein, 41 aa, Artificial Sequence
  Description of Artificial Sequence: Synthetic segment of AB002533b
TSEQTQAVVQSNAVPLFLRLLHSPHQNVCEQAVWALGNIIG

SEQ ID NO: 1176 - protein, 41 aa, Artificial Sequence
  Description of Artificial Sequence: Synthetic segment of HSSRP1Bb
TSAQTQAVVQSNAVPLFLRLLRSPHQNVCEQAVWALGNIIG

SEQ ID NO: 1177 - protein, 41 aa, Artificial Sequence
  Description of Artificial Sequence: Synthetic segment of CELF32E10b
TSEQTQAVVNAGAVPLFLQLLSCGNLNVCEQSVWALGNIIG

SEQ ID NO: 1178 - protein, 41 aa, Artificial Sequence
  Description of Artificial Sequence: Synthetic segment of IMO1HUMANa
TSEQTKAVVDGGAIPAFISLLASPHAHISEQAVWALGNIAG

SEQ ID NO: 1179 - protein, 41 aa, Artificial Sequence
  Description of Artificial Sequence: Synthetic segment of SRP1YEASTb
TSAQTKVVVDADAVPLFIQLLYTGSVEVKEQAIWALGNVAG

SEQ ID NO: 1180 - protein, 41 aa, Artificial Sequence
  Description of Artificial Sequence: Synthetic segment of CEF53B24
SQEVTHLFVNSNCLDILIKLVRSQNARLSSQTVWAIANIAA

SEQ ID NO: 1181 - protein, 41 aa, Artificial Sequence
  Description of Artificial Sequence: Synthetic segment of CELF26B13b
STEQTIAAVEAGVTIPLIHLSVHQSAQISEQALWAVANIAG

SEQ ID NO: 1182 - protein, 42 aa, Artificial Sequence
  Description of Artificial Sequence: Synthetic segment of AB002533a
RNPPIDDLIKSGILPILVHCLERDDNPSLQFEAAWALTNIAS

SEQ ID NO: 1183 - protein, 42 aa, Artificial Sequence
  Description of Artificial Sequence: Synthetic segment of HSSRP1Ba
RNPPIDDLIKSGILPILVKCLERDDNPSLQFEAAWALTNIAS

SEQ ID NO: 1184 - protein, 41 aa, Artificial Sequence
  Description of Artificial Sequence: Synthetic segment of CELF32E10a
RNPPIDDLIGSGILPVLVQCLSSTDPNLQFEAAWALTNIAS

SEQ ID NO: 1185 - protein, 41 aa, Artificial Sequence
  Description of Artificial Sequence: Synthetic segment of CELF26B13a
KNPPIDEVIHCGLLQALVQALSVENERVQYEAAWALTNIVS

SEQ ID NO: 1186 - protein, 42 aa, Artificial Sequence
  Description of Artificial Sequence: Synthetic segment of aATAF00130
QNPPINEVVQSGVVPRVVKFLSRDDFPKLQFEAAWALTNIAS

SEQ ID NO: 1187 - protein, 42 aa, Artificial Sequence; identical to SEQ ID NO: 1186
  Description of Artificial Sequence: Synthetic segment of aATKAPAPRO

SEQ ID NO: 1188 - protein, 42 aa, Artificial Sequence
  Description of Artificial Sequence: Synthetic segment of ATU69533a
RSPPIEEVISAGVVPRFVEFLKKEDYPAIQFEAAWALTNIAS

SEQ ID NO: 1189 - protein, 42 aa, Artificial Sequence
  Description of Artificial Sequence: Synthetic segment of SLU96718a
RSPPIEEVIAAGVVPRLVQFLQRTDYPQLQFEAAWALTNIAS

SEQ ID NO: 1190 - protein, 43 aa, Artificial Sequence
  Description of Artificial Sequence: Synthetic segment of IMO2HUMANa
PNPPIDEVISTPGVVARFVEFLKRKENCSLQFESAWVLTNIAS

SEQ ID NO: 1191 - protein, 42 aa, Artificial Sequence
  Description of Artificial Sequence: Synthetic segment of SRP1YEASTa
HRPPIDVVIQAGVVPRLVEFMRENQPEMLQLEAAWALTNIAS

SEQ ID NO: 1192 - protein, 42 aa, Artificial Sequence
  Description of Artificial Sequence: Synthetic segment of IMO1HUMAN1
KQPPIDNIIRAGLIPKFVSFLGRTDCSPIQFESAWALTNIAS

SEQ ID NO: 1193 - protein, 41 aa, Artificial Sequence
  Description of Artificial Sequence: Synthetic segment of AB002533e
NQQQVQAVIDANLVPMIIHLLDKGDFGTQKEAAWAISNLTI

SEQ ID NO: 1194 - protein, 41 aa, Artificial Sequence; identical to SEQ ID NO: 1193
  Description of Artificial Sequence: Synthetic segment of HSSRP11c

SEQ ID NO: 1195 - protein, 41 aa, Artificial Sequence
  Description of Artificial Sequence: Synthetic segment of CELF32E10e
NQQQVQDVFDAGIMPMIIHLLDRGDFPTQKEAAWAISNVTI

SEQ ID NO: 1196 - protein, 41 aa, Artificial Sequence
  Description of Artificial Sequence: Synthetic segment of IMO2HUMANf
NRAQIQTVIDANIFPALISILQTAEFRTRKEAAWAITNATS

SEQ ID NO: 1197 - protein, 41 aa, Artificial Sequence
  Description of Artificial Sequence: Synthetic segment of MMU34228e
NRAQIQTVIDANMFPALISILQTAEFRTRKEAAWAITNATS

SEQ ID NO: 1198 - protein, 41 aa, Artificial Sequence
  Description of Artificial Sequence: Synthetic segment of eATAF00130
NADQIQAVIDAGIIQSLVWVLQSAEFEVKKEAAWGISNATS

SEQ ID NO: 1199 - protein, 41 aa, Artificial Sequence
  Description of Artificial Sequence: Synthetic segment of ATU69533f
NKDQIQTVVEANLISPLVSLLQNAEFDIKKEAAWAISNATS

SEQ ID NO: 1200 - protein, 41 aa, Artificial Sequence
  Description of Artificial Sequence: Synthetic segment of SRP1YEASTf
NTEQIQAVIDANLIPPLVKLLEVAEYKTKKEACWAISNASS

SEQ ID NO: 1201 - protein, 41 aa, Artificial Sequence
  Description of Artificial Sequence: Synthetic segment of IMO1HUMANe
RQDQIQQVVNHGLVPFLVSVLSKADFKTQKEAVWAVTNYTS

SEQ ID NO: 1202 - protein, 41 aa, Artificial Sequence
  Description of Artificial Sequence: Synthetic segment of CELF26B13e
TQKQIQAVLDANLLPVLINVLKSGDHKCQFEASWALSNLAQ

SEQ ID NO: 1203 - protein, 41 aa, Artificial Sequence
  Description of Artificial Sequence: Synthetic segment of AB002533d
TDEQTQVVLNCDALSHFPALLTHPKEKINKEAVWFLSNITA

SEQ ID NO: 1204 - protein, 41 aa, Artificial Sequence; identical to SEQ ID NO: 1203
  Description of Artificial Sequence: Synthetic segment of HSSRP11b

SEQ ID NO: 1205 - protein, 41 aa, Artificial Sequence
  Description of Artificial Sequence: Synthetic segment of CELF32E10d
TDEQTQLVLDSGVLRFMPGLLAHYKEKINKEAVWFVSNITA

SEQ ID NO: 1206 - protein, 41 aa, Artificial Sequence
  Description of Artificial Sequence: Synthetic segment of IMO1HUMANd
TDEQTQVVIDAGALAVFPSLLTNPKTNIQKEATWTMSNITA

SEQ ID NO: 1207 - protein, 41 aa, Artificial Sequence
  Description of Artificial Sequence: Synthetic segment of IMO2HUMANe
DDIQTQVILNCSALQSLLHLLSSPKESIKKEACWTISNITA

SEQ ID NO: 1208 - protein, 41 aa, Artificial Sequence; identical to SEQ ID NO: 1207
  Description of Artificial Sequence: Synthetic segment of MMU34228d

SEQ ID NO: 1209 - protein, 42 aa, Artificial Sequence
  Description of Artificial Sequence: Synthetic segment of dATAF00130
DDLQTQMVLDQQALPCLLNLLKNNYKKSIKKEACWTISNITA

SEQ ID NO: 1210 - protein, 42 aa, Artificial Sequence
  Description of Artificial Sequence: Synthetic segment of ATU69533e
DDIQTQCVINSGALPCLANLLTQNHKKSIKKEACWTISNITA

SEQ ID NO: 1211 - protein, 41 aa, Artificial Sequence
  Description of Artificial Sequence: Synthetic segment of SRP1YEASTe
NDLQTQVVINAGVLPALRLLLSSPKENIKKEACWTISNITA

SEQ ID NO: 1212 - protein, 42 aa, Artificial Sequence
  Description of Artificial Sequence: Synthetic segment of CELF26B13d
NDSLTQAVIDLGSLDEILPLMEKTRSSSIVKECCWLVSNIIA

SEQ ID NO: 1213 - protein, 41 aa, Artificial Sequence
  Description of Artificial Sequence: Synthetic segment of CRU40057b
SPELAQSVIDSGALDSLVTCLEEFDPGVKEASAWTLGYIAG

SEQ ID NO: 1214 - protein, 42 aa, Artificial Sequence
  Description of Artificial Sequence: Synthetic segment of CRU40057e
SETLALSVIAEKALPPLVSALNEEPEDHLKSATAWTLGQIGR

SEQ ID NO: 1215 - protein, 41 aa, Artificial Sequence
  Description of Artificial Sequence: Synthetic segment of CRU40057d
TPELAQAVVDAGAVAYLAPLVINQDAKLKRQVCCALSQIAK

SEQ ID NO: 1216 - protein, 41 aa, Artificial Sequence
  Description of Artificial Sequence: Synthetic segment of CRU40057c
NADVAQQVVDAGAVPLLVLCVQEPELSLKRIAASALSDISK

SEQ ID NO: 1217 - protein, 41 aa, Artificial Sequence
  Description of Artificial Sequence: Synthetic segment of CTNBMOUSEk
DVHNRIVIRGLNTIPLFVQLLYSPIENIQRVAAGVLCELAQ

SEQ ID NO: 1218 - protein, 41 aa, Artificial Sequence
  Description of Artificial Sequence: Synthetic segment of JC4835h
EALNRSIIRDLNCIPTFVQLLYSEVENIVRVAAGVLCELAQ

SEQ ID NO: 1219 - protein, 63 aa, Artificial Sequence
  Description of Artificial Sequence: Synthetic segment of CTNBMOUSEj
  MOD_RES (24)..(43): Any amino acid
CPANHAPLREQGAIPRLVQLLVRXXXXXXXXXXXXXXXXXXXXGVRMEEIVEGCTGALHILAR

SEQ ID NO: 1220 - protein, 62 aa, Artificial Sequence
  Description of Artificial Sequence: Synthetic segment of HSPLGLNj
  MOD_RES (24)..(42): Any amino acid
CPANHAPLQEAAVIPRLVQLLVKXXXXXXXXXXXXXXXXXXXGVRMEEIVEGCTGALHILAR

SEQ ID NO: 1221 - protein, 60 aa, Artificial Sequence
  Description of Artificial Sequence: Synthetic segment of JC4835g
  MOD_RES (24)..(40): Any amino acid
CPSNHTPIRDQGGLPKLVQLLMKXXXXXXXXXXXXXXXXXGVRMEEIVEGTVGALHILAR

SEQ ID NO: 1222 - protein, 41 aa, Artificial Sequence
  Description of Artificial Sequence: Synthetic segment of HSP0071a
DNKVKMEVCRLGGIKHLVDLLDHRVLEVQKNACGALRNLVF

SEQ ID NO: 1223 - protein, 41 aa, Artificial Sequence
  Description of Artificial Sequence: Synthetic segment of HSU96136a
DNKIKAEIRRQGGIQLLVDLLDHRMTEVHRSACGALRNLVY

SEQ ID NO: 1224 - protein, 41 aa, Artificial Sequence
  Description of Artificial Sequence: Synthetic segment of HSU51269a
NEGVKRRVRQLRGLPLLVALLDHPRAEVRRRACGALRNLSY

SEQ ID NO: 1225 - protein, 41 aa, Artificial Sequence
  Description of Artificial Sequence: Synthetic segment of P120MOUSEa
NDKVKTDVAKLKGIPILVGLLDHPKKEVHLGACGALKNISF

SEQ ID NO: 1226 - protein, 41 aa, Artificial Sequence
  Description of Artificial Sequence: Synthetic segment of S60712a
DESAKQQVYQLGGICKLVDLLRSPNQNVQQAAAGALRNLVF

SEQ ID NO: 1227 - protein, 41 aa, Artificial Sequence
  Description of Artificial Sequence: Synthetic segment of HSRNAUa
KSEARKRVNQLRGILKLLQLLKVQNEDVQRAVCGALRNLVF

SEQ ID NO: 1228 - protein, 43 aa, Artificial Sequence
  Description of Artificial Sequence: Synthetic segment of CTNBMOUSEh
NYKNKMMVCQVGGIEALVRTVLRAGDREDITEPAICALRHLTS

SEQ ID NO: 1229 - protein, 43 aa, Artificial Sequence
  Description of Artificial Sequence: Synthetic segment of JC4835e
NPRNKQVVFQVGGIEALVRTIINAGDREEITEPAVCALRHLTS

SEQ ID NO: 1230 - protein, 41 aa, Artificial Sequence
  Description of Artificial Sequence: Synthetic segment of YEB3YEASTb
NNENKLLIVEMGGLEPLINQMMGDNVEVQCNAVGCITNLAT

SEQ ID NO: 1231 - protein, 42 aa, Artificial Sequence
  Description of Artificial Sequence: Synthetic segment of YEB3YEASTf
HPLNEGLIVDAGFLKPLVRLLDYKDSEEIQCHAVSTLRNLAA

SEQ ID NO: 1232 - protein, 42 aa, Artificial Sequence
  Description of Artificial Sequence: Synthetic segment of P120MOUSEb
DQDNKIAIKNCDGVPALVRLLRKARDMDLTEVITGTLWNLSS

SEQ ID NO: 1233 - protein, 42 aa, Artificial Sequence
  Description of Artificial Sequence: Synthetic segment of HSU51269b
DTDNKAAIRDCGGVPALVRLLRAARDNEVRELVTGTLWNLSS

SEQ ID NO: 1234 - protein, 42 aa, Artificial Sequence
  Description of Artificial Sequence: Synthetic segment of HSP0071b
TDENKIAMKNVGGIPALLRLLRKSIDAEVRELVTGVLWNLSS

SEQ ID NO: 1235 - protein, 42 aa, Artificial Sequence
  Description of Artificial Sequence: Synthetic segment of HSU96136b
NDDNKIALKNCGGIPALVRLLRKTTDLEIRELVTGVLWNLSS

SEQ ID NO: 1236 - protein, 42 aa, Artificial Sequence
  Description of Artificial Sequence: Synthetic segment of S60712b
STTNKLETRRQNGIREAVSLLRRTGNAEIQKQLTGLLWNLSS

SEQ ID NO: 1237 - protein, 42 aa, Artificial Sequence
  Description of Artificial Sequence: Synthetic segment of HSRNAUb
DNDNKLEVAELNGVPRLLQVLKQTRDLETKKQITGLLWNLSS

SEQ ID NO: 1238 - protein, 41 aa, Artificial Sequence
  Description of Artificial Sequence: Synthetic segment of HSU96136c
SVYIRAAVRKEKGRPILVELLRIDNDRVACAVATALRNMAL

SEQ ID NO: 1239 - protein, 41 aa, Artificial Sequence
  Description of Artificial Sequence: Synthetic segment of HSP0071c
AAYIRGGRPKRKGLPILVELLRMDNDRVVSSGATALRNMAL

SEQ ID NO: 1240 - protein, 41 aa, Artificial Sequence
  Description of Artificial Sequence: Synthetic segment of HSU51269c
ATYIRATVRKERGLPVLVELLQSETDKVVRAVAIALRNLSL

SEQ ID NO: 1241 - protein, 41 aa, Artificial Sequence
  Description of Artificial Sequence: Synthetic segment of P120MOUSEc
GRYIRSALRQEKALSARAELLTSEHERVVKAASGALRNLAV

SEQ ID NO: 1242 - protein, 42 aa, Artificial Sequence
  Description of Artificial Sequence: Synthetic segment of CTNBMOUSEi
AEMAQNAVRLHYGLPVVVKLLHPPSHWPLIKATVGLIRNLAL

SEQ ID NO: 1243 - protein, 42 aa, Artificial Sequence
  Description of Artificial Sequence: Synthetic segment of JC4835f
AEHAENGVRLHYGIPILVKLLNPPSRWPLIKAVVGLIRNLGL

SEQ ID NO: 1244 - protein, 41 aa, Artificial Sequence
  Description of Artificial Sequence: Synthetic segment of CTNBMOUSEc
HREGLLAIFKSGGIPALVKMLGSPVDSVLFYAITTLHNLLL

SEQ ID NO: 1245 - protein, 41 aa, Artificial Sequence
  Description of Artificial Sequence: Synthetic segment of JC4835a
HRQGLMAIFKCSGIPALVKLLGHRIEAVVFYAITTLHNLLL

SEQ ID NO: 1246 - protein, 43 aa, Artificial Sequence
  Description of Artificial Sequence: Synthetic segment of JC6161b
DDSCAALLAKSGIIPALIELLNAQQEDDEFVCQIIYVFYQMVF

SEQ ID NO: 1247 - protein, 43 aa, Artificial Sequence; identical to SEQ ID NO: 1246
  Description of Artificial Sequence: Synthetic segment of HSU59919b

SEQ ID NO: 1248 - protein, 43 aa, Artificial Sequence
  Description of Artificial Sequence: Synthetic segment of SPU38655b
DDSCAAMLAKSGIIQSLIELLNAKQEDDEIVCQIVYVFYQMVF

SEQ ID NO: 1249 - protein, 41 aa, Artificial Sequence
  Description of Artificial Sequence: Synthetic segment of CTNBMOUSEf
CSSNKPAIVEAGGMQALGLHLTDPSQRLVQNCLWTLRNLSD

SEQ ID NO: 1250 - protein, 41 aa, Artificial Sequence
  Description of Artificial Sequence: Synthetic segment of JC4835d
CSSNKPAIVEAGGMQALAHYLSHQSTRLVQNCLWTLRNLSD

SEQ ID NO: 1251 - protein, 41 aa, Artificial Sequence
  Description of Artificial Sequence: Synthetic segment of CELC54D15
SNFDAPNLVAFGGRQILANLLSHGSPRLVQSTLETLRNISD

SEQ ID NO: 1252 - protein, 42 aa, Artificial Sequence
  Description of Artificial Sequence: Synthetic segment of APCHUMAc
DVANKATLCSMKGCMRALVAQLKSESEDLQQVIASVLRNLSW

SEQ ID NO: 1253 - protein, 42 aa, Artificial Sequence
  Description of Artificial Sequence: Synthetic segment of XLU64442c
DVANKATLCSMKSCMRALVAQLKSESEDLQQVIASVLRNLSW

SEQ ID NO: 1254 - protein, 42 aa, Artificial Sequence
  Description of Artificial Sequence: Synthetic segment of DMU77947c
DENNKALLCGQKQFMEALVAQLDSAPDDLLQVTASVLRNLSW

SEQ ID NO: 1255 - protein, 41 aa, Artificial Sequence
  Description of Artificial Sequence: Synthetic segment of JC6161a
FMENKNDMVEMDIVEKLVKMIPCEHEDLLNITLRLLLNLSF

SEQ ID NO: 1256 - protein, 41 aa, Artificial Sequence; identical to SEQ ID NO: 1255
  Description of Artificial Sequence: Synthetic segment of HSU59919a

SEQ ID NO: 1257 - protein, 41 aa, Artificial Sequence
  Description of Artificial Sequence: Synthetic segment of SPU38655a
YVENKNEMAEQQIIERLAKLVPCDHEDLLNITLRLLLNLSF

SEQ ID NO: 1258 - protein, 41 aa, Artificial Sequence
  Description of Artificial Sequence: Synthetic segment of CTNBMOUSEd
QEGAKMAVRLAGGLQKMVALLNKTNVKFLAITTDCLQILAY

SEQ ID NO: 1259 - protein, 41 aa, Artificial Sequence
  Description of Artificial Sequence: Synthetic segment of JC4835b
QEGAKMAVRLALGLQKMVSLLQRPKVKFLAIVTDCLQILAY

SEQ ID NO: 1260 - protein, 42 aa, Artificial Sequence
  Description of Artificial Sequence: Synthetic segment of CTNBMOUSEe
NQESKLIILASGGPQALVNIMRTYTYEKLLWTTSRVLKVLSV

SEQ ID NO: 1261 - protein, 42 aa, Artificial Sequence
  Description of Artificial Sequence: Synthetic segment of JC4835c
NQESKLIILSSGGPAELVRIMRSYTYEKLLYTTCRVLKVLSV

SEQ ID NO: 1262 - protein, 45 aa, Artificial Sequence
  Description of Artificial Sequence: Synthetic segment of HSP0071d
NMENAKALADSGGIEKLVNITKGRGDRSSLKVVKAAAQVLNTLWQ

SEQ ID NO: 1263 - protein, 45 aa, Artificial Sequence
  Description of Artificial Sequence: Synthetic segment of HSU96136d
NMENAKALRDAGGIEKLVGISKSKGDKHSPKVVKAASQVLNSMWQ

SEQ ID NO: 1264 - protein, 40 aa, Artificial Sequence
  Description of Artificial Sequence: Synthetic segment of IMO1HUMANb
NPAPPIDAVEQILPTLVRLLHHDDPEVLADTCWAISYLTD

SEQ ID NO: 1265 - protein, 40 aa, Artificial Sequence
  Description of Artificial Sequence: Synthetic segment of ATU69533c
KPQPHFDQVKPALPALERLIHSDAEEALTDACWALSYLSD

SEQ ID NO: 1266 - protein, 40 aa, Artificial Sequence
  Description of Artificial Sequence: Synthetic segment of CELF32E10-
DPAPSPAVVRTILPALSLLIHHQDTNILIDTVWALSYLTD

SEQ ID NO: 1267 - protein, 40 aa, Artificial Sequence
  Description of Artificial Sequence: Synthetic segment of AB002533z
DPPPPMETIQEILPALCVLIHHTDVNILVDTVWALSYLTD

SEQ ID NO: 1268 - protein, 43 aa, Artificial Sequence
  Description of Artificial Sequence: Synthetic segment of IMO2HUMAN-
DSTMCRDYVLDCNILPPLLQLFSKQNRLTMTRNAVWALSNLCR

SEQ ID NO: 1269 - protein, 43 aa, Artificial Sequence
  Description of Artificial Sequence: Synthetic segment of MMU34228b
DSTMCRDYVLNCNILPPLLQLFSKQNRLTMTRNAVWALSNLCR

SEQ ID NO: 1270 - protein, 42 aa, Artificial Sequence
  Description of Artificial Sequence: Synthetic segment of SRP1YEASTc
DSTDYRDYVLQCNAMEPILGLFNSNKPSLIRTATWTLSNLCR

SEQ ID NO: 1271 - protein, 40 aa, Artificial Sequence
  Description of Artificial Sequence: Synthetic segment of IMOB_RAT
EPNQLKPLVIQAMPTLIELMKDPSVVVRDTTAWTVGRICE

SEQ ID NO: 1272 - protein, 40 aa, Artificial Sequence
  Description of Artificial Sequence: Synthetic segment of HUMNTF9
EPSQLKPLVIQAMPTLIELMKDPSVVVRDTAAWTVGRICE

SEQ ID NO: 1273 - protein, 41 aa, Artificial Sequence
  Description of Artificial Sequence: Synthetic segment of APCHUMANe
NEDHRQILRENNCLQTLLQHLKSHSLTIVSNACGTLWNLSA

SEQ ID NO: 1274 - protein, 41 aa, Artificial Sequence; identical to SEQ ID NO: 1273
  Description of Artificial Sequence: Synthetic segment of XLU64442d

SEQ ID NO: 1275 - protein, 41 aa, Artificial Sequence
  Description of Artificial Sequence: Synthetic segment of DMU77947d
CEPYRQILRQHNCLAILLQQLKSESLTVVSNSCGTLWNLSA

SEQ ID NO: 1276 - protein, 52 aa, Artificial Sequence
  Description of Artificial Sequence: Synthetic segment of APCHUMANb
  MOD_RES (24)..(31): Any amino acid
DEEHRHAMNELGGLQAIAELLQVXXXXXXXXNDHYSITLRRYAGMALTNLTF

SEQ ID NO: 1277 - protein, 52 aa, Artificial Sequence
  Description of Artificial Sequence: Synthetic segment of XLU64442b
  MOD_RES (24)..(31): Any amino acid
DEEHRHAMNELGGLQAIAELLQVXXXXXXXXNDHYSVTLRRYAGMALTNLTF

SEQ ID NO: 1278 - protein, 53 aa, Artificial Sequence
  Description of Artificial Sequence: Synthetic segment of DMU77947b
  MOD_RES (24)..(33): Any amino acid
DEEHRHAMCELGALHAIPNLVHLXXXXXXXXXXDQCCNSLRRYALMALTNLTF

SEQ ID NO: 1279 - protein, 41 aa, Artificial Sequence
  Description of Artificial Sequence: Synthetic segment of fATAF00130
THDQIKFMVSQGCIKPLCDLLTCPDLKVVTVCLEALENILV

SEQ ID NO: 1280 - protein, 41 aa, Artificial Sequence; identical to SEQ ID NO: 1279
  Description of Artificial Sequence: Synthetic segment of dATKAPAPRO

SEQ ID NO: 1281 - protein, 41 aa, Artificial Sequence
  Description of Artificial Sequence: Synthetic segment of ATU69533g
SHDQIKYLVEQGCIKPLCDLLVCPDPRIITVCLEGLENILK

SEQ ID NO: 1282 - protein, 41 aa, Artificial Sequence
  Description of Artificial Sequence: Synthetic segment of IMO2HUMANg
SAEQIKYLVELGCIKPLCDLLTVMDSKIVQVALNGLENILR

SEQ ID NO: 1283 - protein, 41 aa, Artificial Sequence
  Description of Artificial Sequence: Synthetic segment of MMU34228f
SAEQIKYLVELGCIKPLCDLLTVMDAKIVQVALNGLENILR

SEQ ID NO: 1284 - protein, 41 aa, Artificial Sequence
  Description of Artificial Sequence: Synthetic segment of SRP1YEASTg
RPDIIRYLVSQGCIKPLCDLLEIADNRIIEVTLDALENILK

SEQ ID NO: 1285 - protein, 41 aa, Artificial Sequence
  Description of Artificial Sequence: Synthetic segment of IMO1HUMANf
TVEQIVYLVHCGIIEPLMNLLTAKDTKIILVILDAISNIFQ

SEQ ID NO: 1286 - protein, 41 aa, Artificial Sequence
  Description of Artificial Sequence: Synthetic segment of AB002533f
RKDQVAYLIQQNVIPPFCNLLTVKDAQVVQVVLDGLSNILK

SEQ ID NO: 1287 - protein, 41 aa, Artificial Sequence; identical to SEQ ID NO: 1286
  Description of Artificial Sequence: Synthetic segment of HSSRP11d

SEQ ID NO: 1288 - protein, 41 aa, Artificial Sequence
  Description of Artificial Sequence: Synthetic segment of CELF32E10g
RPNQVEQMVKLGVLRPFCAMLSCTDSQIIQVVLDGINNILK

SEQ ID NO: 1289 - protein, 53 aa, Artificial Sequence
  Description of Artificial Sequence: Synthetic segment of APCHUMANa
  MOD_RES (24)..(33): Any amino acid
SQDSCISMRQSGCLPLLIQLLHGXXXXXXXXXXSRGSKEARARASAALHNIIH

SEQ ID NO: 1290 - protein, 53 aa, Artificial Sequence
  Description of Artificial Sequence: Synthetic segment of XLU64442a
  MOD_RES (24)..(33): Any amino acid
SQDSCIAMRQSGCLPLLIQLLHGXXXXXXXXXXSRGSKEARASGSAALDNIIH

SEQ ID NO: 1291 - protein, 43 aa, Artificial Sequence
  Description of Artificial Sequence: Synthetic segment of DMU77947a
NAQSCATLRRSGCMPLLVQMMHAPDNDQEVRKCAEQALHNVVH

SEQ ID NO: 1292 - protein, 41 aa, Artificial Sequence
  Description of Artificial Sequence: Synthetic segment of CTNBMOUSEl
DKEAAEAIEAEGATAPLTELLHSRNEGVATYAAAVLFRMSE

SEQ ID NO: 1293 - protein, 41 aa, Artificial Sequence
  Description of Artificial Sequence: Synthetic segment of JC4835i
DKEGADAIEREGATTILTELLHSRNDGIAAYARAVLFRMSE

SEQ ID NO: 1294 - protein, 41 aa, Artificial Sequence
  Description of Artificial Sequence: Synthetic segment of CELF08F8
FDENKIVMEQNGTIEKLLKLFPIQDPELRKAVIMLLFNFSF

SEQ ID NO: 1295 - protein, 46 aa, Artificial Sequence
  Description of Artificial Sequence: Synthetic segment of GDS1HUMANc
RNDANCIHMVDNGIVEKLMDLLDRHVEDGNVTVQHAALSALRNLAI

SEQ ID NO: 1296 - protein, 42 aa, Artificial Sequence
  Description of Artificial Sequence: Synthetic segment of AT81KBGEN4
NDRNKKIIVDEGGVSPLLRLLKESSSAEGQIAAATALGLLAC

SEQ ID NO: 1297 - protein, 41 aa, Artificial Sequence
  Description of Artificial Sequence: Synthetic segment of S51350
PDKVQRTYYVHQALPSILNLMNDQSLQVKETTAWCIGRIAD

SEQ ID NO: 1298 - protein, 40 aa, Artificial Sequence
  Description of Artificial Sequence: Synthetic segment of CELF26B13c
PDEQIELARESGVLPHVVAFFKEAENLVAPALRTLGNVAT

SEQ ID NO: 1299 - protein, 43 aa, Artificial Sequence
  Description of Artificial Sequence: Synthetic segment of HSU51269d
DSLDNARSLLQARGVPALVALVASSQSVREAKAASHVLQTVWS

SEQ ID NO: 1300 - protein, 44 aa, Artificial Sequence
  Description of Artificial Sequence: Synthetic segment of CELF26B13-
SSQLRDYVIKCHGVEALMHLMEKVDQLGDSHVRTIAWAFSNMCR

SEQ ID NO: 1301 - protein, 41 aa, Artificial Sequence
  Description of Artificial Sequence: Synthetic segment of YEB3YEASTd
SEENRKELVNAGAVPVLVSLLSSTDPDVQYYCTTALSNIAV

SEQ ID NO: 1302 - protein, 42 aa, Artificial Sequence
  Description of Artificial Sequence: Synthetic segment of GDS1HUMANa
KNEFMRIPCVDAGLISPLVQLLNSKDQEVLLQTGRALGNICY

SEQ ID NO: 1303 - protein, 42 aa, Artificial Sequence
  Description of Artificial Sequence: Synthetic segment of YEB3YEASTe
SDTSYQLEIVRAGGLPHLVKLIQSDSIPLVLASVACIRNISI

SEQ ID NO: 1304 - protein, 40 aa, Artificial Sequence
  Description of Artificial Sequence: Synthetic segment of CTNBMOUSEa
NYQDDAELATRAIPELTKLLNDEDQVVVNKAAVMVHQLSK

SEQ ID NO: 1305 - protein, 42 aa, Artificial Sequence
  Description of Artificial Sequence: Synthetic segment of ADBHUMAN
LHDINAQMVEDQGFLDSLRDLIADSNPMVVANAVAALSEISE

SEQ ID NO: 1306 - protein, 41 aa, Artificial Sequence
  Description of Artificial Sequence: Synthetic segment of S60712c
SGMSQLIGLKEKGLPQIARLLQSGNSDVVRSGASLLSNMSR

SEQ ID NO: 1307 - protein, 42 aa, Artificial Sequence
  Description of Artificial Sequence: Synthetic segment of HSRNAUd
PTSVAQTVVQKESGLQHTRKMLHVGDPSVKKTAISLLRNLSR

SEQ ID NO: 1308 - protein, 44 aa, Artificial Sequence
  Description of Artificial Sequence: Synthetic segment of YEB3YEASTa
FAEITEKYVRQVSREVLEPILILLQSQDPQIQVAACAALGNLAV

SEQ ID NO: 1309 - protein, 48 aa, Artificial Sequence
  Description of Artificial Sequence: Synthetic segment of HSRNAUc
  MOD_RES (24)..(27): Any amino acid
GADGRKAMRRCDGLIDSLVHYVRXXXXDYQPDDKATENCVCILHNLSY

SEQ ID NO: 1310 - protein, 43 aa, Artificial Sequence
  Description of Artificial Sequence: Synthetic segment of CTNBMOUSEb
KEASRHAIMRSPQMVSAIVRTMQNTNDVETARCTAGTLHNLSH

SEQ ID NO: 1311 - protein, 42 aa, Artificial Sequence
  Description of Artificial Sequence: Synthetic segment of CET19B106
ANQKHLEYVVELGMLSAFTDLLTCMDVSLVSYILDAIYLLLQ

SEQ ID NO: 1312 - protein, 41 aa, Artificial Sequence
  Description of Artificial Sequence: Synthetic segment of YSPPAA1B
AAGGDSTVYEQQIIPLLEQLTKDNDPDVQYFATQALEQTND

SEQ ID NO: 1313 - protein, 41 aa, Artificial Sequence
  Description of Artificial Sequence: Synthetic segment of CRU40057a
NPQNIEALQQAGAMALLRPLLLDNVPSIQQSAALALGRLAN

SEQ ID NO: 1314 - protein, 41 aa, Artificial Sequence
  Description of Artificial Sequence: Synthetic segment of D87671
YSDSLTAAMIDAVLDELPPLISESDMHVSQMAISFLTTLAK

SEQ ID NO: 1315 - protein, 42 aa, Artificial Sequence
  Description of Artificial Sequence: Synthetic segment of CELM01E114
SQPDLYGSFVEVNGVEILLQLLGHENTDIVCATLSLLRELTD

SEQ ID NO: 1316 - protein, 44 aa, Artificial Sequence
  Description of Artificial Sequence: Synthetic segment of HSZYGHOMO
ETPDNCEMFLNFNGMKLFLDCLKEFPEKQELIRNMLGLLGNVAE

SEQ ID NO: 1317 - protein, 42 aa, Artificial Sequence
  Description of Artificial Sequence: Synthetic segment of YLK3CAEELa
CEEQAREQIRIYDGVPTLLGLLSIKNSRLQWHVAWTLAQLAE

SEQ ID NO: 1318 - protein, 44 aa, Artificial Sequence
  Description of Artificial Sequence: Synthetic segment of GDS1HUMANb
DSHSLQAQLINMGVIPTLVKLLGIHCQNAALTEMCLVAFGNLAE

SEQ ID NO: 1319 - protein, 43 aa, Artificial Sequence
  Description of Artificial Sequence: Synthetic segment of COPBYEASTa
RQDANRTPALKAQYIELLMELLSTTTSDEVIFETALALTVLSA

SEQ ID NO: 1320 - protein, 43 aa, Artificial Sequence
  Description of Artificial Sequence: Synthetic segment of CEC48D1
KSSKACTNMIQAGIISISLSCMEKVESNDITTKCLELLTNLSS

SEQ ID NO: 1321 - protein, 41 aa, Artificial Sequence
  Description of Artificial Sequence: Synthetic segment of YEB3YEASTc
RDDNKHKIATSGALIPLTKLAKSKHIRVQRNATGALLNMTH

SEQ ID NO: 1322 - protein, 42 aa, Artificial Sequence
  Description of Artificial Sequence: Synthetic segment of GDS1BOVINc
KSKDVIKTIVQSGGIKHLVTMATSEHVIMQNEALVALALIAA

SEQ ID NO: 1323 - protein, 46 aa, Artificial Sequence
  Description of Artificial Sequence: Synthetic segment of APCHUMANd
ADVNSKKTLREVGSVKALMECALEVKKESTLKSVLSALWNLSARNP

SEQ ID NO: 1324 - protein, 42 aa, Artificial Sequence
  Description of Artificial Sequence: Synthetic segment of P115_BOVIN
SKKYRLEVGIQAMEHLIHVLQTDRSDSEIIGYALDTLYNIIS

SEQ ID NO: 1325 - protein, 41 aa, Artificial Sequence
  Description of Artificial Sequence: Synthetic segment of YD71_SCHPO
PLEMIQIVTKMNIPDHLTATLPRSSDDIQNDCLFALRQVSK

SEQ ID NO: 1326 - protein, 42 aa, Artificial Sequence
  Description of Artificial Sequence: Synthetic segment of CELB033611
SDLPAIQEQDMKESIHCIVQLIGCSDVTIVELATGTLRNIGL

SEQ ID NO: 1327 - protein, 31 aa, Artificial Sequence
  Description of Artificial Sequence: Synthetic polypeptide
RSKKAHVLAASVEQATQNFLEKGEQIAKESQ

SEQ ID NO: 1328 - protein, 20 aa, Artificial Sequence
  Description of Artificial Sequence: Synthetic peptide
RTLTVERLLEPLVTQVTTLV

SEQ ID NO: 1329 - protein, 57 aa, Artificial Sequence
  Description of Artificial Sequence: Synthetic polypeptide
RREQLEAQEARAREAHAREAHAREAYTREAYGREAYAREAHTWEAHGREARTREAQA

SEQ ID NO: 1330 - protein, 9 aa, Artificial Sequence
  Description of Artificial Sequence: Synthetic peptide
  MOD_RES (2)..(3): Any amino acid
DXXEFDQYL

SEQ ID NO: 1331 - protein, 33 aa, Artificial Sequence
  Description of Artificial Sequence: Synthetic polypeptide
QALLDKAKINQGWLDSSRSLMEQDKENEALLRF

SEQ ID NO: 1332 - protein, 15 aa, Artificial Sequence
  Description of Artificial Sequence: Synthetic peptide
FEGIALTNYLKALEG

SEQ ID NO: 1333 - protein, 6 aa, Artificial Sequence
  Description of Artificial Sequence: Synthetic peptide
PLYISY

SEQ ID NO: 1334 - protein, 19 aa, Artificial Sequence
  Description of Artificial Sequence: Synthetic peptide
SIEDLHEYWARLWNYLYVA

SEQ ID NO: 1335 - protein, 20 aa, Artificial Sequence
  Description of Artificial Sequence: Synthetic peptide
QASLEELHEYWARLWNYRVA

SEQ ID NO: 1336 - protein, 22 aa, Artificial Sequence
  Description of Artificial Sequence: Synthetic peptide
NASIKQLHAYWQRLYAYLAAVA

SEQ ID NO: 1337 - protein, 12 aa, Artificial Sequence
  Description of Artificial Sequence: Synthetic peptide
CMWWREICPVWW

SEQ ID NO: 1338 - protein, 11 aa, Artificial Sequence
  Description of Artificial Sequence: Synthetic peptide
FARKTFLKLAF

SEQ ID NO: 1339 - protein, 10 aa, Artificial Sequence
  Description of Artificial Sequence: Synthetic peptide
ARRFFLDIAD

SEQ ID NO: 1340 - protein, 10 aa, Artificial Sequence
  Description of Artificial Sequence: Synthetic peptide
  MOD_RES (5)..(6): Any amino acid
  MOD_RES (9)..(10): Any amino acid
FRWPXXRLXX

SEQ ID NO: 1341 - protein, 8 aa, Artificial Sequence
  Description of Artificial Sequence: Synthetic peptide
  MOD_RES (1)..(1): A, C, D, E, G, H, K, N, Q, R, S, or T
  MOD_RES (2)..(2): A, C, D, E, F, G, H, I, K, L, M, N, P, Q, R, S, T, V, W, or Y
  MOD_RES (5)..(5): Any amino acid
  MOD_RES (6)..(6): A, C, F, G, H, I, K, L, M, R, T, V, W, or Y
  MOD_RES (7)..(7): A, C, D, E, F, G, H, I, K, L, M, N, P, Q, R, S, T, V, W, or Y
  MOD_RES (8)..(8): C, D, E, H, K, N, Q, R, S, or T
XXVFXXXX

SEQ ID NO: 1342 - protein, 9 aa, Artificial Sequence
  Description of Artificial Sequence: Synthetic peptide
YGHGQVYYY

SEQ ID NO: 1343 - protein, 6 aa, Artificial Sequence
  Description of Artificial Sequence: Synthetic peptide
ENPKQN

SEQ ID NO: 1344 - protein, 12 aa, Artificial Sequence
  Description of Artificial Sequence: Synthetic peptide
DAYECLDASRPW

SEQ ID NO: 1345 - protein, 7 aa, Artificial Sequence
  Description of Artificial Sequence: Synthetic peptide
KSRDFYH

SEQ ID NO: 1346 - protein, 16 aa, Artificial Sequence
  Description of Artificial Sequence: Synthetic peptide
AGVEHQLRREVEIQSH

SEQ ID NO: 1347 - protein, 25 aa, Artificial Sequence
  Description of Artificial Sequence: Synthetic peptide
WSVHAPSSRRTTLAGTLDYLPPEMI

SEQ ID NO: 1348 - protein, 6 aa, Artificial Sequence
  Description of Artificial Sequence: Synthetic peptide
TYQETY

SEQ ID NO: 1349 - protein, 32 aa, Artificial Sequence
  Description of Artificial Sequence: Synthetic polypeptide
QAEEQKLSEEDLLRKRREQLKHKLEQLRNSCA

SEQ ID NO: 1350 - protein, 14 aa, Artificial Sequence
  Description of Artificial Sequence: Synthetic peptide
NELKRSFAALRDQI

SEQ ID NO: 1351 - protein, 14 aa, Artificial Sequence
  Description of Artificial Sequence: Synthetic peptide
NELKRAFAALRDQI

SEQ ID NO: 1352 - protein, 29 aa, Artificial Sequence
  Description of Artificial Sequence: Synthetic peptide
IREKNHYHRQEVDDLRRQNALLEQQVRAL

SEQ ID NO: 1353 - protein, 11 aa, Artificial Sequence
  Description of Artificial Sequence: Synthetic peptide
FNHITNASQWE

SEQ ID NO: 1354 - protein, 11 aa, Artificial Sequence
  Description of Artificial Sequence: Synthetic peptide
GDLGAFSRGQM

SEQ ID NO: 1355 - protein, 17 aa, Artificial Sequence
  Description of Artificial Sequence: Synthetic peptide
RSEFYYYGNTYYYSAMD

SEQ ID NO: 1356 - protein, 9 aa, Artificial Sequence
  Description of Artificial Sequence: Synthetic peptide
QHDYTATDE

SEQ ID NO: 1357 - protein, 10 aa, Artificial Sequence
  Description of Artificial Sequence: Synthetic peptide
QNPEEQDEGW

SEQ ID NO: 1358 - protein, 11 aa, Artificial Sequence
  Description of Artificial Sequence: Synthetic peptide
EKCRGVFPENF

SEQ ID NO: 1359 - protein, 19 aa, Artificial Sequence
  Description of Artificial Sequence: Synthetic peptide
GAYPEYILDIHVYRVQLEL

SEQ ID NO: 1360 - protein, 22 aa, Artificial Sequence
  Description of Artificial Sequence: Synthetic peptide
SQEQLEHRYRSLITLYDIQLML

SEQ ID NO: 1361 - protein, 19 aa, Artificial Sequence
  Description of Artificial Sequence: Synthetic peptide
QELGDNDELMHFSYESTQD

SEQ ID NO: 1362 - protein, 16 aa, Artificial Sequence
  Description of Artificial Sequence: Synthetic peptide
YAYQRAIVEYMLRLMS

SEQ ID NO: 1363 - protein, 14 aa, Artificial Sequence
  Description of Artificial Sequence: Synthetic peptide
YEQAIAAYLDALMC

SEQ ID NO: 1364 - protein, 16 aa, Artificial Sequence
  Description of Artificial Sequence: Synthetic peptide
SCSEELEALEALELDE

SEQ ID NO: 1365 - protein, 31 aa, Artificial Sequence; identical to SEQ ID NO: 1327
  Description of Artificial Sequence: Synthetic polypeptide

SEQ ID NO: 1366 - protein, 20 aa, Artificial Sequence
  Description of Artificial Sequence: Synthetic peptide
RTLTVERLLEPLVTQVTTLV

SEQ ID NO: 1367 - protein, 57 aa, Artificial Sequence; identical to SEQ ID NO: 1329
  Description of Artificial Sequence: Synthetic polypeptide

SEQ ID NO: 1368 - protein, 9 aa, Artificial Sequence
  Description of Artificial Sequence: Synthetic peptide
  MOD_RES (2)..(3): Any amino acid
DXXEFDQYL

SEQ ID NO: 1369 - protein, 33 aa, Artificial Sequence; identical to SEQ ID NO: 1331
  Description of Artificial Sequence: Synthetic polypeptide

SEQ ID NO: 1370 - protein, 15 aa, Artificial Sequence
  Description of Artificial Sequence: Synthetic peptide
FEGIALTNYLKALEG

SEQ ID NO: 1371 - protein, 6 aa, Artificial Sequence
  Description of Artificial Sequence: Synthetic peptide
PLYISY

SEQ ID NO: 1372 - protein, 19 aa, Artificial Sequence
  Description of Artificial Sequence: Synthetic peptide
SIEDLHEYWARLWNYLYVA

SEQ ID NO: 1373 - protein, 20 aa, Artificial Sequence
  Description of Artificial Sequence: Synthetic peptide
QASLEELHEYWARLWNYRVA

SEQ ID NO: 1374 - protein, 22 aa, Artificial Sequence
  Description of Artificial Sequence: Synthetic peptide
NASIKQLHAYWQRLYAYLAAVA

SEQ ID NO: 1375 - protein, 12 aa, Artificial Sequence
  Description of Artificial Sequence: Synthetic peptide
CMWWREICPVWW

SEQ ID NO: 1376 - protein, 11 aa, Artificial Sequence
  Description of Artificial Sequence: Synthetic peptide
FARKTFLKLAF

SEQ ID NO: 1377 - protein, 10 aa, Artificial Sequence
  Description of Artificial Sequence: Synthetic peptide
ARRFFLDIAD

SEQ ID NO: 1378 - protein, 10 aa, Artificial Sequence
  Description of Artificial Sequence: Synthetic peptide
  MOD_RES (5)..(6): Any amino acid
  MOD_RES (9)..(10): Any amino acid
FRWPXXRLXX

SEQ ID NO: 1379 - protein, 8 aa, Artificial Sequence
  Description of Artificial Sequence: Synthetic peptide
  MOD_RES (1)..(1): A, C, D, E, G, H, K, N, Q, R, S, or T
  MOD_RES (2)..(2): A, C, D, E, F, G, H, I, K, L, M, N, P, Q, R, S, T, V, W, or Y
  MOD_RES (5)..(5): Any amino acid
  MOD_RES (6)..(6): A, C, F, G, H, I, K, L, M, R, T, V, W, or Y
  MOD_RES (7)..(7): A, C, D, E, F, G, H, I, K, L, M, N, P, Q, R, S, T, V, W, or Y
  MOD_RES (8)..(8): C, D, E, H, K, N, Q, R, S, or T
XXVFXXXX

SEQ ID NO: 1380 - protein, 9 aa, Artificial Sequence
  Description of Artificial Sequence: Synthetic peptide
YGHGQVYYY

SEQ ID NO: 1381 - protein, 6 aa, Artificial Sequence
  Description of Artificial Sequence: Synthetic peptide
ENPKQN

SEQ ID NO: 1382 - protein, 12 aa, Artificial Sequence
  Description of Artificial Sequence: Synthetic peptide
DAYECLDASRPW

SEQ ID NO: 1383 - protein, 7 aa, Artificial Sequence
  Description of Artificial Sequence: Synthetic peptide
KSRDFYH

SEQ ID NO: 1384 - protein, 16 aa, Artificial Sequence
  Description of Artificial Sequence: Synthetic peptide
AGVEHQLRREVEIQSH

SEQ ID NO: 1385 - protein, 25 aa, Artificial Sequence
  Description of Artificial Sequence: Synthetic peptide
WSVHAPSSRRTTLAGTLDYLPPEMI

SEQ ID NO: 1386 - protein, 6 aa, Artificial Sequence
  Description of Artificial Sequence: Synthetic peptide
TYQETY

SEQ ID NO: 1387 - protein, 32 aa, Artificial Sequence; identical to SEQ ID NO: 1349
  Description of Artificial Sequence: Synthetic polypeptide

SEQ ID NO: 1388 - protein, 14 aa, Artificial Sequence
  Description of Artificial Sequence: Synthetic peptide
NELKRSFAALRDQI

SEQ ID NO: 1389 - protein, 14 aa, Artificial Sequence
  Description of Artificial Sequence: Synthetic peptide
NELKRAFAALRDQI

SEQ ID NO: 1390 - protein, 29 aa, Artificial Sequence
  Description of Artificial Sequence: Synthetic peptide
IREKNHYHRQEVDDLRRQNALLEQQVRAL

SEQ ID NO: 1391 - protein, 11 aa, Artificial Sequence
  Description of Artificial Sequence: Synthetic peptide
FNHITNASQWE

SEQ ID NO: 1392 - protein, 11 aa, Artificial Sequence
  Description of Artificial Sequence: Synthetic peptide
GDLGAFSRGQM

SEQ ID NO: 1393 - protein, 17 aa, Artificial Sequence
  Description of Artificial Sequence: Synthetic peptide
RSEFYYYGNTYYYSAMD

SEQ ID NO: 1394 - protein, 9 aa, Artificial Sequence
  Description of Artificial Sequence: Synthetic peptide
QHDYTATDE

SEQ ID NO: 1395 - protein, 10 aa, Artificial Sequence
  Description of Artificial Sequence: Synthetic peptide
QNPEEQDEGW

SEQ ID NO: 1396 - protein, 11 aa, Artificial Sequence
  Description of Artificial Sequence: Synthetic peptide
EKCRGVFPENF

SEQ ID NO: 1397 - protein, 13 aa, Artificial Sequence
  Description of Artificial Sequence: Synthetic peptide
KWTLERLKRKYRN

SEQ ID NO: 1398 - protein, 17 aa, Artificial Sequence
  Description of Artificial Sequence: Synthetic peptide
TWRVQRSQNPLKIRLTR

SEQ ID NO: 1399 - protein, 12 aa, Artificial Sequence
  Description of Artificial Sequence: Synthetic peptide
TMRGKKKRTRAN

SEQ ID NO: 1400 - protein, 15 aa, Artificial Sequence
  Description of Artificial Sequence: Synthetic peptide
SYSYDAPSDFINFSS

SEQ ID NO: 1401 - protein, 37 aa, Artificial Sequence
  Description of Artificial Sequence: Synthetic polypeptide
SYSYDAPSDFINFSSLDDEGDTQNIDSWFEEKANLEN

SEQ ID NO: 1402 - protein, 24 aa, Artificial Sequence
  Description of Artificial Sequence: Synthetic peptide
MSQVKSSYSYDAPSDFINFSSLDD

SEQ ID NO: 1403 - protein, 31 aa, Artificial Sequence
  Description of Artificial Sequence: Synthetic polypeptide
MALSPSRGFAEHSSEPPSWVTIMLYENELWI

SEQ ID NO: 1404 - protein, 29 aa, Artificial Sequence
  Description of Artificial Sequence: Synthetic peptide
LEFDSLQPCFYPDEDDFYFGGPDSTPPGE

SEQ ID NO: 1405 - protein, 15 aa, Artificial Sequence
  Description of Artificial Sequence: Synthetic peptide
RLYGFKIHPMAYQLQ

SEQ ID NO: 1406 - protein, 19 aa, Artificial Sequence
  Description of Artificial Sequence: Synthetic peptide
EPPLNPHGSARAEVHLRKS

SEQ ID NO: 1407 - protein, 20 aa, Artificial Sequence
  Description of Artificial Sequence: Synthetic peptide
SAVMERLRRRIELCRRHHST

SEQ ID NO: 1408 - protein, 22 aa, Artificial Sequence
  Description of Artificial Sequence: Synthetic peptide
TYTKKQVLRMEHLVLKVLTFDL

SEQ ID NO: 1409 - protein, 20 aa, Artificial Sequence
  Description of Artificial Sequence: Synthetic peptide
LVCKSYRLDWEAGALFRSLF

SEQ ID NO: 1410 - protein, 20 aa, Artificial Sequence
  Description of Artificial Sequence: Synthetic peptide
YSFVHHGFFNFRVSWREMLA

SEQ ID NO: 1411 - protein, 5 aa, Artificial Sequence
  Description of Artificial Sequence: Synthetic peptide
TAALS

SEQ ID NO: 1412 - protein, 5 aa, Artificial Sequence
  Description of Artificial Sequence: Synthetic peptide
TALLS

SEQ ID NO: 1413 - protein, 5 aa, Artificial Sequence
  Description of Artificial Sequence: Synthetic peptide
LAALS

SEQ ID NO: 1414 - protein, 5 aa, Artificial Sequence
  Description of Artificial Sequence: Synthetic peptide
DAALT

SEQ ID NO: 1415 - protein, 5 aa, Artificial Sequence
  Description of Artificial Sequence: Synthetic peptide
YAALQ

SEQ ID NO: 1416 - protein, 11 aa, Artificial Sequence
  Description of Artificial Sequence: Synthetic peptide
  MOD_RES (4)..(4): Any amino acid
SKLXRFTGCSC

SEQ ID NO: 1417 - protein, 8 aa, Artificial Sequence
  Description of Artificial Sequence: Synthetic peptide
PVKRRLFL

SEQ ID NO: 1418 - protein, 26 aa, Artificial Sequence
  Description of Artificial Sequence: Synthetic peptide
GRKRRQTSMTDFYHSKRRLIFSKRKP

SEQ ID NO: 1419 - protein, 16 aa, Artificial Sequence
  Description of Artificial Sequence: Synthetic peptide
MAGPMQTSTPKNAGKK

SEQ ID NO: 1420 - protein, 9 aa, Artificial Sequence
  Description of Artificial Sequence: Synthetic peptide
FDPPLHSTA

SEQ ID NO: 1421 - protein, 7 aa, Artificial Sequence
  Description of Artificial Sequence: Synthetic peptide
PLHSTAI

SEQ ID NO: 1422 - protein, 6 aa, Artificial Sequence
  Description of Artificial Sequence: Synthetic peptide
MDSTPL

SEQ ID NO: 1423 - protein, 7 aa, Artificial Sequence
  Description of Artificial Sequence: Synthetic peptide
FSQHKTI

SEQ ID NO: 1424 - protein, 11 aa, Artificial Sequence
  Description of Artificial Sequence: Synthetic peptide
LHYPSTTALQE

SEQ ID NO: 1425 - protein, 9 aa, Artificial Sequence
  Description of Artificial Sequence: Synthetic peptide
LLCSTPNGL

SEQ ID NO: 1426 - protein, 12 aa, Artificial Sequence
  Description of Artificial Sequence: Synthetic peptide
EAIYAAPFAKKK

SEQ ID NO: 1427 - protein, 9 aa, Artificial Sequence
  Description of Artificial Sequence: Synthetic peptide
APSYPPPPP

SEQ ID NO: 1428 - protein, 8 aa, Artificial Sequence
  Description of Artificial Sequence: Synthetic peptide
LQTIQEEE

SEQ ID NO: 1429 - protein, 4 aa, Artificial Sequence
  Description of Artificial Sequence: Synthetic peptide
SILK

SEQ ID NO: 1430 - protein, 15 aa, Artificial Sequence
  Description of Artificial Sequence: Synthetic peptide
SRRVSFADTIKVFQT

SEQ ID NO: 1431 - protein, 27 aa, Artificial Sequence
  Description of Artificial Sequence: Synthetic peptide
FSSNRQKILERTEILNQEWKQRRIQPV

SEQ ID NO: 1432 - protein, 21 aa, Artificial Sequence
  Description of Artificial Sequence: Synthetic peptide
KALETLRRVGDGVQRNHETAF

SEQ ID NO: 1433 - protein, 25 aa, Artificial Sequence
  Description of Artificial Sequence: Synthetic peptide
AELEVESATQLRRFGDKLNFRQKLL

SEQ ID NO: 1434 - protein, 21 aa, Artificial Sequence
  Description of Artificial Sequence: Synthetic peptide
  MOD_RES (8)..(8): Any amino acid
  MOD_RES (12)..(12): Any amino acid
KALETLRXVGDXVQRNHETAF

SEQ ID NO: 1435 - protein, 11 aa, Artificial Sequence
  Description of Artificial Sequence: Synthetic peptide
KEAPPAPPQDP

SEQ ID NO: 1436 - protein, 8 aa, Artificial Sequence
  Description of Artificial Sequence: Synthetic peptide
LSRRPDYR

SEQ ID NO: 1437 - protein, 14 aa, Artificial Sequence
  Description of Artificial Sequence: Synthetic peptide
RREGGMSRPADVDG

SEQ ID NO: 1438 - protein, 26 aa, Artificial Sequence
  Description of Artificial Sequence: Synthetic peptide
YRRAAVPPSPSLSRHSSPSQDEDEEE

SEQ ID NO: 1439 - protein, 9 aa, Artificial Sequence
  Description of Artificial Sequence: Synthetic peptide
SGWTVVRMY

SEQ ID NO: 1440 - protein, 8 aa, Artificial Sequence
  Description of Artificial Sequence: Synthetic peptide
REAGDGEE

SEQ ID NO: 1441 - protein, 14 aa, Artificial Sequence
  Description of Artificial Sequence: Synthetic peptide
HLQREAGDGEEFRS

SEQ ID NO: 1442 - protein, 21 aa, Artificial Sequence
  Description of Artificial Sequence: Synthetic peptide
IWIAQELRRIGDEFNAYYARR

SEQ ID NO: 1443 - protein, 16 aa, Artificial Sequence
  Description of Artificial Sequence: Synthetic peptide
GQVGRQLAIIGDDINR

SEQ ID NO: 1444 - protein, 25 aa, Artificial Sequence
  Description of Artificial Sequence: Synthetic peptide
NLWAAQRYGRELRRMSDEFVDSFKK

SEQ ID NO: 1445 - protein, 42 aa, Artificial Sequence
  Description of Artificial Sequence: Synthetic polypeptide
SIAATLEKEEANLEKMNKKLAAEIESLLKEKDKLESVLNYHE

SEQ ID NO: 1446 - protein, 32 aa, Artificial Sequence
  Description of Artificial Sequence: Synthetic polypeptide
VQEIEQEIQELEKRIKQIQQEFQEIEQQIALL

SEQ ID NO: 1447 - protein, 15 aa, Artificial Sequence
  Description of Artificial Sequence: Synthetic peptide
ATQLRRFGDKLNFRQ

SEQ ID NO: 1448 - protein, 20 aa, Artificial Sequence
  Description of Artificial Sequence: Synthetic peptide
EIVAKYIHYKLSQRGYEWDA

SEQ ID NO: 1449 - protein, 14 aa, Artificial Sequence
  Description of Artificial Sequence: Synthetic peptide
KKRYDREFLLGFQF

SEQ ID NO: 1450 - protein, 34 aa, Artificial Sequence
  Description of Artificial Sequence: Synthetic polypeptide
GKKRYDREFLLGFQFIFASMQKPEGLPHISDVVL

SEQ ID NO: 1451 - protein, 34 aa, Artificial Sequence
  Description of Artificial Sequence: Synthetic polypeptide
TKLIYERAFMKNLRGSPLSQTPPSNVPSCLLRGT

SEQ ID NO: 1452 - protein, 36 aa, Artificial Sequence
  Description of Artificial Sequence: Synthetic polypeptide
AIARLEERVKTLKAEIYELRSKANMLREQIAQLGAP

SEQ ID NO: 1453 - protein, 36 aa, Artificial Sequence
  Description of Artificial Sequence: Synthetic polypeptide
AIARLEERVKTLKAEIYELQSEANMLREQIAQLGAP

SEQ ID NO: 1454 - protein, 15 aa, Artificial Sequence
  Description of Artificial Sequence: Synthetic peptide
HIRGSITQGIPRSYV

SEQ ID NO: 1455 - protein, 9 aa, Artificial Sequence
  Description of Artificial Sequence: Synthetic peptide
GRSIHEIPR

SEQ ID NO: 1456 - protein, 21 aa, Artificial Sequence
  Description of Artificial Sequence: Synthetic peptide
GLVATVKEAGRSIHEIPREEL

SEQ ID NO: 1457 - protein, 12 aa, Artificial Sequence
  Description of Artificial Sequence: Synthetic peptide
KDYEEVGVDSVE

SEQ ID NO: 1458 - protein, 13 aa, Artificial Sequence
  Description of Artificial Sequence: Synthetic peptide
YQQYQDATADEQG

SEQ ID NO: 1459 - protein, 20 aa, Artificial Sequence
  Description of Artificial Sequence: Synthetic peptide
DAVRRIEDMMNQARHASSGV

SEQ ID NO: 1460 - protein, 13 aa, Artificial Sequence
  Description of Artificial Sequence: Synthetic peptide
YVYNTRSGWRWYT

SEQ ID NO: 1461 - protein, 17 aa, Artificial Sequence
  Description of Artificial Sequence: Synthetic peptide
VRKRTLRRLLQERELVE

SEQ ID NO: 1462 - protein, 28 aa, Artificial Sequence
  Description of Artificial Sequence: Synthetic peptide
RQVRELENYIDRLVRVMEETPNILRIPR

SEQ ID NO: 1463 - protein, 7 aa, Artificial Sequence
  Description of Artificial Sequence: Synthetic peptide
KKSRALF

SEQ ID NO: 1464 - protein, 12 aa, Artificial Sequence
  Description of Artificial Sequence: Synthetic peptide
RCLSSSAVANRS

SEQ ID NO: 1465 - protein, 12 aa, Artificial Sequence
  Description of Artificial Sequence: Synthetic peptide
RSLSSSAVANRS

SEQ ID NO: 1466 - protein, 13 aa, Artificial Sequence
  Description of Artificial Sequence: Synthetic peptide
AVANRSKKSRALF

SEQ ID NO: 1467 - protein, 19 aa, Artificial Sequence
  Description of Artificial Sequence: Synthetic peptide
RCESSSAEANRSKKERELF

SEQ ID NO: 1468 - protein, 13 aa, Artificial Sequence
  Description of Artificial Sequence: Synthetic peptide
ASSESQRYVYSIL

SEQ ID NO: 1469 - protein, 13 aa, Artificial Sequence
  Description of Artificial Sequence: Synthetic peptide
ASSASQEYVYSIL

SEQ ID NO: 1470 - protein, 18 aa, Artificial Sequence
  Description of Artificial Sequence: Synthetic peptide
RSSAMDENSEKKRKSAIK

SEQ ID NO: 1471 - protein, 14 aa, Artificial Sequence
  Description of Artificial Sequence: Synthetic peptide
GDENSEKKRKQAIK

SEQ ID NO: 1472 - protein, 10 aa, Artificial Sequence
  Description of Artificial Sequence: Synthetic peptide
SGRRYGHALR

SEQ ID NO: 1473 - protein, 10 aa, Artificial Sequence
  Description of Artificial Sequence: Synthetic peptide
ATGAPRLPST

SEQ ID NO: 1474 - protein, 10 aa, Artificial Sequence
  Description of Artificial Sequence: Synthetic peptide
RLAHGYRRGS

SEQ ID NO: 1475 - protein, 13 aa, Artificial Sequence
  Description of Artificial Sequence: Synthetic peptide
RTLFKAHMGQKHR

SEQ ID NO: 1476 - protein, 10 aa, Artificial Sequence
  Description of Artificial Sequence: Synthetic peptide
YSRVGRSVTD

SEQ ID NO: 1477 - protein, 12 aa, Artificial Sequence
  Description of Artificial Sequence: Synthetic peptide
HSKGHQKRKALK

SEQ ID NO: 1478 - protein, 12 aa, Artificial Sequence
  Description of Artificial Sequence: Synthetic peptide
MGYQKKLRSMTD

SEQ ID NO: 1479 - protein, 16 aa, Artificial Sequence
  Description of Artificial Sequence: Synthetic peptide
MGYQKKLRSMTDKYRL

SEQ ID NO: 1480 - protein, 10 aa, Artificial Sequence
  Description of Artificial Sequence: Synthetic peptide
GMRPYDANKR

SEQ ID NO: 1481 - protein, 7 aa, Artificial Sequence
  Description of Artificial Sequence: Synthetic peptide
GRPYDAN

SEQ ID NO: 1482 - protein, 16 aa, Artificial Sequence
  Description of Artificial Sequence: Synthetic peptide
KIHKKGMIKSSRPLRV

SEQ ID NO: 1483 - protein, 10 aa, Artificial Sequence
  Description of Artificial Sequence: Synthetic peptide
KIHKKGMIKS

SEQ ID NO: 1484 - protein, 12 aa, Artificial Sequence
  Description of Artificial Sequence: Synthetic peptide
KIHKKGMIKSSR

SEQ ID NO: 1485 - protein, 16 aa, Artificial Sequence
  Description of Artificial Sequence: Synthetic peptide
KRKALKALILNEKKVQ

SEQ ID NO: 1486 - protein, 12 aa, Artificial Sequence
  Description of Artificial Sequence: Synthetic peptide
TFVADWRNSNRY

SEQ ID NO: 1487 - protein, 23 aa, Artificial Sequence
  Description of Artificial Sequence: Synthetic peptide
TWAWHTSFKALGTTYQPLSGKTS

SEQ ID NO: 1488 - protein, 31 aa, Artificial Sequence
  Description of Artificial Sequence: Synthetic polypeptide
RGVMTLFSIKSNHPGLLSEKAASKINETMLR

SEQ ID NO: 1489 - protein, 12 aa, Artificial Sequence
  Description of Artificial Sequence: Synthetic peptide
RNNSRLGNGVLY

SEQ ID NO: 1490 - protein, 10 aa, Artificial Sequence
  Description of Artificial Sequence: Synthetic peptide
RRERRDLFTE

SEQ ID NO: 1491 - protein, 12 aa, Artificial Sequence
  Description of Artificial Sequence: Synthetic peptide
MGETVNKIAQES

SEQ ID NO: 1492 - protein, 11 aa, Artificial Sequence
  Description of Artificial Sequence: Synthetic peptide
RASQYFSSYLA

SEQ ID NO: 1493 - protein, 16 aa, Artificial Sequence
  Description of Artificial Sequence: Synthetic peptide
AREDFRNRRLWYVMDY

SEQ ID NO: 1494 - protein, 13 aa, Artificial Sequence
  Description of Artificial Sequence: Synthetic peptide
KASGYSFTDYFIY

SEQ ID NO: 1495 - protein, 8 aa, Artificial Sequence
  Description of Artificial Sequence: Synthetic peptide
YRDRRRPS

SEQ ID NO: 1496 - protein, 13 aa, Artificial Sequence
  Description of Artificial Sequence: Synthetic peptide
SGSSSDIGSNYVS

SEQ ID NO: 1497 - protein, 9 aa, Artificial Sequence
  Description of Artificial Sequence: Synthetic peptide
QQWSSHIFT

SEQ ID NO: 1498 - protein, 14 aa, Artificial Sequence
  Description of Artificial Sequence: Synthetic peptide
ASRDYDYAGRYFDY

SEQ ID NO: 1499 - protein, 9 aa, Artificial Sequence
  Description of Artificial Sequence: Synthetic peptide
QNGHSFPFT

SEQ ID NO: 1500 - protein, 10 aa, Artificial Sequence
  Description of Artificial Sequence: Synthetic peptide
YINPYNDGTK

SEQ ID NO: 1501 - protein, 8 aa, Artificial Sequence
  Description of Artificial Sequence: Synthetic peptide
ARNWDVAY

SEQ ID NO: 1502 - protein, 11 aa, Artificial Sequence
  Description of Artificial Sequence: Synthetic peptide
SGYSFTGHWMN

SEQ ID NO: 1503 - protein, 10 aa, Artificial Sequence
  Description of Artificial Sequence: Synthetic peptide
MIHPSDSETR

SEQ ID NO: 1504 - protein, 14 aa, Artificial Sequence
  Description of Artificial Sequence: Synthetic peptide
ARGIYFYGTTYFDY

SEQ ID NO: 1505 - protein, 10 aa, Artificial Sequence
  Description of Artificial Sequence: Synthetic peptide
SGFSFTSSVS

SEQ ID NO: 1506 - protein, 9 aa, Artificial Sequence
  Description of Artificial Sequence: Synthetic peptide
LIYPYNGFN

SEQ ID NO: 1507 - protein, 13 aa, Artificial Sequence
  Description of Artificial Sequence: Synthetic peptide
AASGFTFTSTGIS

SEQ ID NO: 1508 - protein, 15 aa, Artificial Sequence
  Description of Artificial Sequence: Synthetic peptide
ARTYGIYDLYVDYTE

SEQ ID NO: 1509 - protein, 9 aa, Artificial Sequence
  Description of Artificial Sequence: Synthetic peptide
SRDYGYYFD

SEQ ID NO: 1510 - protein, 10 aa, Artificial Sequence
  Description of Artificial Sequence: Synthetic peptide
GYSFTRYWMH

SEQ ID NO: 1511 - protein, 8 aa, Artificial Sequence
  Description of Artificial Sequence: Synthetic peptide
QWWWWPST

SEQ ID NO: 1512 - protein, 12 aa, Artificial Sequence
  Description of Artificial Sequence: Synthetic peptide
ASGFSIWWSWIH

SEQ ID NO: 1513 - protein, 8 aa, Artificial Sequence
  Description of Artificial Sequence: Synthetic peptide
YDNNQRPS

SEQ ID NO: 1514 - protein, 17 aa, Artificial Sequence
  Description of Artificial Sequence: Synthetic peptide
TFHIRRYRSGYYDKMDH

SEQ ID NO: 1515 - protein, 12 aa, Artificial Sequence
  Description of Artificial Sequence: Synthetic peptide
ARGPFSPWVMDY

SEQ ID NO: 1516 - protein, 9 aa, Artificial Sequence
  Description of Artificial Sequence: Synthetic peptide
TRHDGTNFD

SEQ ID NO: 1517 - protein, 9 aa, Artificial Sequence
  Description of Artificial Sequence: Synthetic peptide
QQAKAFPPT

SEQ ID NO: 1518 - protein, 12 aa, Artificial Sequence
  Description of Artificial Sequence: Synthetic peptide
SGHVNAVKNYGY

SEQ ID NO: 1519 - protein, 8 aa, Artificial Sequence
  Description of Artificial Sequence: Synthetic peptide
WINTETGS

SEQ ID NO: 1520 - protein, 8 aa, Artificial Sequence
  Description of Artificial Sequence: Synthetic peptide
WINTYTGE

SEQ ID NO: 1521 - protein, 10 aa, Artificial Sequence
  Description of Artificial Sequence: Synthetic peptide
GYTFTNYGMN

SEQ ID NO: 1522 - protein, 13 aa, Artificial Sequence
  Description of Artificial Sequence: Synthetic peptide
KWTLERLKRKYRN

SEQ ID NO: 1523 - protein, 17 aa, Artificial Sequence
  Description of Artificial Sequence: Synthetic peptide
TWRVQRSQNPLKIRLTR

SEQ ID NO: 1524 - protein, 12 aa, Artificial Sequence
  Description of Artificial Sequence: Synthetic peptide
TMRGKKKRTRAN

SEQ ID NO: 1525 - protein, 15 aa, Artificial Sequence
  Description of Artificial Sequence: Synthetic peptide
SYSYDAPSDFINFSS

SEQ ID NO: 1526 - protein, 37 aa, Artificial Sequence; identical to SEQ ID NO: 1401
  Description of Artificial Sequence: Synthetic polypeptide

SEQ ID NO: 1527 - protein, 24 aa, Artificial Sequence
  Description of Artificial Sequence: Synthetic peptide
MSQVKSSYSYDAPSDFINFSSLDD

SEQ ID NO: 1528 - protein, 31 aa, Artificial Sequence; identical to SEQ ID NO: 1403
  Description of Artificial Sequence: Synthetic polypeptide

SEQ ID NO: 1529 - protein, 29 aa, Artificial Sequence
  Description of Artificial Sequence: Synthetic peptide
LEFDSLQPCFYPDEDDFYFGGPDSTPPGE

SEQ ID NO: 1530 - protein, 15 aa, Artificial Sequence
  Description of Artificial Sequence: Synthetic peptide
RLYGFKIHPMAYQLQ

SEQ ID NO: 1531 - protein, 19 aa, Artificial Sequence
  Description of Artificial Sequence: Synthetic peptide
EPPLNPHGSARAEVHLRKS

SEQ ID NO: 1532 - protein, 20 aa, Artificial Sequence
  Description of Artificial Sequence: Synthetic peptide
SAVMERLRRRIELCRRHHST

SEQ ID NO: 1533 - protein, 22 aa, Artificial Sequence
  Description of Artificial Sequence: Synthetic peptide
TYTKKQVLRMEHLVLKVLTFDL

SEQ ID NO: 1534 - protein, 20 aa, Artificial Sequence
  Description of Artificial Sequence: Synthetic peptide
LVCKSYRLDWEAGALFRSLF

SEQ ID NO: 1535 - protein, 20 aa, Artificial Sequence
  Description of Artificial Sequence: Synthetic peptide
YSFVHHGFFNFRVSWREMLA

SEQ ID NO: 1536 - protein, 5 aa, Artificial Sequence
  Description of Artificial Sequence: Synthetic peptide
TAALS

SEQ ID NO: 1537 - protein, 5 aa, Artificial Sequence
  Description of Artificial Sequence: Synthetic peptide
TALLS

SEQ ID NO: 1538 - protein, 5 aa, Artificial Sequence
  Description of Artificial Sequence: Synthetic peptide
LAALS

SEQ ID NO: 1539 - protein, 5 aa, Artificial Sequence
  Description of Artificial Sequence: Synthetic peptide
DAALT

SEQ ID NO: 1540 - protein, 5 aa, Artificial Sequence
  Description of Artificial Sequence: Synthetic peptide
YAALQ

SEQ ID NO: 1541 - protein, 11 aa, Artificial Sequence
  Description of Artificial Sequence: Synthetic peptide
  MOD_RES (4)..(4): Any amino acid
SKLXRFTGCSC

SEQ ID NO: 1542 - protein, 8 aa, Artificial Sequence
  Description of Artificial Sequence: Synthetic peptide
PVKRRLFL

SEQ ID NO: 1543 - protein, 26 aa, Artificial Sequence
  Description of Artificial Sequence: Synthetic peptide
GRKRRQTSMTDFYHSKRRLIFSKRKP

SEQ ID NO: 1544 - protein, 16 aa, Artificial Sequence
  Description of Artificial Sequence: Synthetic peptide
MAGPMQTSTPKNAGKK

SEQ ID NO: 1545 - protein, 9 aa, Artificial Sequence
  Description of Artificial Sequence: Synthetic peptide
FDPPLHSTA

SEQ ID NO: 1546 - protein, 7 aa, Artificial Sequence
  Description of Artificial Sequence: Synthetic peptide
PLHSTAI

SEQ ID NO: 1547 - protein, 6 aa, Artificial Sequence
  Description of Artificial Sequence: Synthetic peptide
MDSTPL

SEQ ID NO: 1548 - protein, 7 aa, Artificial Sequence
  Description of Artificial Sequence: Synthetic peptide
FSQHKTI

SEQ ID NO: 1549 - protein, 11 aa, Artificial Sequence
  Description of Artificial Sequence: Synthetic peptide
LHYPSTTALQE

SEQ ID NO: 1550 - protein, 9 aa, Artificial Sequence
  Description of Artificial Sequence: Synthetic peptide
LLCSTPNGL

SEQ ID NO: 1551 - protein, 12 aa, Artificial Sequence
  Description of Artificial Sequence: Synthetic peptide
EAIYAAPFAKKK

SEQ ID NO: 1552 - protein, 9 aa, Artificial Sequence
  Description of Artificial Sequence: Synthetic peptide
APSYPPPPP

SEQ ID NO: 1553 - protein, 8 aa, Artificial Sequence
  Description of Artificial Sequence: Synthetic peptide
LQTIQEEE

SEQ ID NO: 1554 - protein, 4 aa, Artificial Sequence
  Description of Artificial Sequence: Synthetic peptide
SILK

SEQ ID NO: 1555 - protein, 15 aa, Artificial Sequence
  Description of Artificial Sequence: Synthetic peptide
SRRVSFADTIKVFQT

SEQ ID NO: 1556 - protein, 27 aa, Artificial Sequence
  Description of Artificial Sequence: Synthetic peptide
FSSNRQKILERTEILNQEWKQRRIQPV

SEQ ID NO: 1557 - protein, 21 aa, Artificial Sequence
  Description of Artificial Sequence: Synthetic peptide
KALETLRRVGDGVQRNHETAF

SEQ ID NO: 1558 - protein, 25 aa, Artificial Sequence
  Description of Artificial Sequence: Synthetic peptide
AELEVESATQLRRFGDKLNFRQKLL

SEQ ID NO: 1559 - protein, 21 aa, Artificial Sequence
  Description of Artificial Sequence: Synthetic peptide
  MOD_RES (8)..(8): Any amino acid
  MOD_RES (12)..(12): Any amino acid
KALETLRXVGDXVQRNHETAF

SEQ ID NO: 1560 - protein, 19 aa, Artificial Sequence
  Description of Artificial Sequence: Synthetic peptide
GAYPEYILDIHVYRVQLEL

SEQ ID NO: 1561 - protein, 22 aa, Artificial Sequence
  Description of Artificial Sequence: Synthetic peptide
SQEQLEHRYRSLITLYDIQLML

SEQ ID NO: 1562 - protein, 19 aa, Artificial Sequence
  Description of Artificial Sequence: Synthetic peptide
QELGDNDELMHFSYESTQD

SEQ ID NO: 1563 - protein, 16 aa, Artificial Sequence
  Description of Artificial Sequence: Synthetic peptide
YAYQRAIVEYMLRLMS

SEQ ID NO: 1564 - protein, 14 aa, Artificial Sequence
  Description of Artificial Sequence: Synthetic peptide
YEQAIAAYLDALMC

SEQ ID NO: 1565 - protein, 16 aa, Artificial Sequence
  Description of Artificial Sequence: Synthetic peptide
SCSEELEALEALELDE

SEQ ID NO: 1566 - protein, 31 aa, Artificial Sequence; identical to SEQ ID NO: 1327
  Description of Artificial Sequence: Synthetic polypeptide

SEQ ID NO: 1567 - protein, 20 aa, Artificial Sequence
  Description of Artificial Sequence: Synthetic peptide
RTLTVERLLEPLVTQVTTLV

SEQ ID NO: 1568 - protein, 57 aa, Artificial Sequence; identical to SEQ ID NO: 1329
  Description of Artificial Sequence: Synthetic polypeptide

SEQ ID NO: 1569 - protein, 9 aa, Artificial Sequence
  Description of Artificial Sequence: Synthetic peptide
  MOD_RES (2)..(3): Any amino acid
DXXEFDQYL

SEQ ID NO: 1570 - protein, 33 aa, Artificial Sequence; identical to SEQ ID NO: 1331
  Description of Artificial Sequence: Synthetic polypeptide

SEQ ID NO: 1571 - protein, 15 aa, Artificial Sequence
  Description of Artificial Sequence: Synthetic peptide
FEGIALTNYLKALEG

SEQ ID NO: 1572 - protein, 6 aa, Artificial Sequence
  Description of Artificial Sequence: Synthetic peptide
PLYISY

SEQ ID NO: 1573 - protein, 19 aa, Artificial Sequence
  Description of Artificial Sequence: Synthetic peptide
SIEDLHEYWARLWNYLYVA

SEQ ID NO: 1574 - protein, 20 aa, Artificial Sequence
  Description of Artificial Sequence: Synthetic peptide
QASLEELHEYWARLWNYRVA

SEQ ID NO: 1575 - protein, 22 aa, Artificial Sequence
  Description of Artificial Sequence: Synthetic peptide
NASIKQLHAYWQRLYAYLAAVA

SEQ ID NO: 1576 - protein, 12 aa, Artificial Sequence
  Description of Artificial Sequence: Synthetic peptide
CMWWREICPVWW

SEQ ID NO: 1577 - protein, 11 aa, Artificial Sequence
  Description of Artificial Sequence: Synthetic peptide
FARKTFLKLAF

SEQ ID NO: 1578 - protein, 10 aa, Artificial Sequence
  Description of Artificial Sequence: Synthetic peptide
ARRFFLDIAD

SEQ ID NO: 1579 - protein, 10 aa, Artificial Sequence
  Description of Artificial Sequence: Synthetic peptide
  MOD_RES (5)..(6): Any amino acid
  MOD_RES (9)..(10): Any amino acid
FRWPXXRLXX

SEQ ID NO: 1580 - protein, 8 aa, Artificial Sequence
  Description of Artificial Sequence: Synthetic peptide
  MOD_RES (1)..(1): A, C, D, E, G, H, K, N, Q, R, S, or T
  MOD_RES (2)..(2): A, C, D, E, F, G, H, I, K, L, M, N, P, Q, R, S, T, V, W, or Y
  MOD_RES (5)..(5): Any amino acid
  MOD_RES (6)..(6): A, C, F, G, H, I, K, L, M, R, T, V, W, or Y
  MOD_RES (7)..(7): A, C, D, E, F, G, H, I, K, L, M, N, P, Q, R, S, T, V, W, or Y
  MOD_RES (8)..(8): C, D, E, H, K, N, Q, R, S, or T
XXVFXXXX

SEQ ID NO: 1581 - protein, 9 aa, Artificial Sequence
  Description of Artificial Sequence: Synthetic peptide
YGHGQVYYY

SEQ ID NO: 1582 - protein, 6 aa, Artificial Sequence
  Description of Artificial Sequence: Synthetic peptide
ENPKQN

SEQ ID NO: 1583 - protein, 12 aa, Artificial Sequence
  Description of Artificial Sequence: Synthetic peptide
DAYECLDASRPW

SEQ ID NO: 1584 - protein, 7 aa, Artificial Sequence
  Description of Artificial Sequence: Synthetic peptide
KSRDFYH

SEQ ID NO: 1585 - protein, 16 aa, Artificial Sequence
  Description of Artificial Sequence: Synthetic peptide
AGVEHQLRREVEIQSH

SEQ ID NO: 1586 - protein, 25 aa, Artificial Sequence
  Description of Artificial Sequence: Synthetic peptide
WSVHAPSSRRTTLAGTLDYLPPEMI

SEQ ID NO: 1587 - protein, 6 aa, Artificial Sequence
  Description of Artificial Sequence: Synthetic peptide
TYQETY

SEQ ID NO: 1588 - protein, 32 aa, Artificial Sequence; identical to SEQ ID NO: 1349
  Description of Artificial Sequence: Synthetic polypeptide

SEQ ID NO: 1589 - protein, 14 aa, Artificial Sequence
  Description of Artificial Sequence: Synthetic peptide
NELKRSFAALRDQI

SEQ ID NO: 1590 - protein, 14 aa, Artificial Sequence
  Description of Artificial Sequence: Synthetic peptide
NELKRAFAALRDQI

SEQ ID NO: 1591 - protein, 29 aa, Artificial Sequence
  Description of Artificial Sequence: Synthetic peptide
IREKNHYHRQEVDDLRRQNALLEQQVRAL

SEQ ID NO: 1592 - protein, 11 aa, Artificial Sequence
  Description of Artificial Sequence: Synthetic peptide
FNHITNASQWE

SEQ ID NO: 1593 - protein, 11 aa, Artificial Sequence
  Description of Artificial Sequence: Synthetic peptide
GDLGAFSRGQM

SEQ ID NO: 1594 - protein, 17 aa, Artificial Sequence
  Description of Artificial Sequence: Synthetic peptide
RSEFYYYGNTYYYSAMD

SEQ ID NO: 1595 - protein, 9 aa, Artificial Sequence
  Description of Artificial Sequence: Synthetic peptide
QHDYTATDE

SEQ ID NO: 1596 - protein, 10 aa, Artificial Sequence
  Description of Artificial Sequence: Synthetic peptide
QNPEEQDEGW

SEQ ID NO: 1597 - protein, 11 aa, Artificial Sequence
  Description of Artificial Sequence: Synthetic peptide
EKCRGVFPENF

SEQ ID NO: 1598 - protein, 13 aa, Artificial Sequence
  Description of Artificial Sequence: Synthetic peptide
KWTLERLKRKYRN

SEQ ID NO: 1599 - protein, 17 aa, Artificial Sequence
  Description of Artificial Sequence: Synthetic peptide
TWRVQRSQNPLKIRLTR

SEQ ID NO: 1600 - protein, 12 aa, Artificial Sequence
  Description of Artificial Sequence: Synthetic peptide
TMRGKKKRTRAN

SEQ ID NO: 1601 - protein, 15 aa, Artificial Sequence
  Description of Artificial Sequence: Synthetic peptide
SYSYDAPSDFINFSS

SEQ ID NO: 1602 - protein, 37 aa, Artificial Sequence; identical to SEQ ID NO: 1401
  Description of Artificial Sequence: Synthetic polypeptide

SEQ ID NO: 1603 - protein, 24 aa, Artificial Sequence
  Description of Artificial Sequence: Synthetic peptide
MSQVKSSYSYDAPSDFINFSSLDD

SEQ ID NO: 1604 - protein, 31 aa, Artificial Sequence; identical to SEQ ID NO: 1403
  Description of Artificial Sequence: Synthetic polypeptide

SEQ ID NO: 1605 - protein, 29 aa, Artificial Sequence
  Description of Artificial Sequence: Synthetic peptide
LEFDSLQPCFYPDEDDFYFGGPDSTPPGE

SEQ ID NO: 1606 - protein, 15 aa, Artificial Sequence
  Description of Artificial Sequence: Synthetic peptide
RLYGFKIHPMAYQLQ

SEQ ID NO: 1607 - protein, 19 aa, Artificial Sequence
  Description of Artificial Sequence: Synthetic peptide
EPPLNPHGSARAEVHLRKS

SEQ ID NO: 1608 - protein, 20 aa, Artificial Sequence
  Description of Artificial Sequence: Synthetic peptide
SAVMERLRRRIELCRRHHST

SEQ ID NO: 1609 - protein, 22 aa, Artificial Sequence
  Description of Artificial Sequence: Synthetic peptide
TYTKKQVLRMEHLVLKVLTFDL

SEQ ID NO: 1610 - protein, 20 aa, Artificial Sequence
  Description of Artificial Sequence: Synthetic peptide
LVCKSYRLDWEAGALFRSLF

SEQ ID NO: 1611 - protein, 20 aa, Artificial Sequence
  Description of Artificial Sequence: Synthetic peptide
YSFVHHGFFNFRVSWREMLA

SEQ ID NO: 1612 - protein, 5 aa, Artificial Sequence
  Description of Artificial Sequence: Synthetic peptide
TAALS

SEQ ID NO: 1613 - protein, 5 aa, Artificial Sequence
  Description of Artificial Sequence: Synthetic peptide
TALLS

SEQ ID NO: 1614 - protein, 5 aa, Artificial Sequence
  Description of Artificial Sequence: Synthetic peptide
LAALS

SEQ ID NO: 1615 - protein, 5 aa, Artificial Sequence
  Description of Artificial Sequence: Synthetic peptide
DAALT

SEQ ID NO: 1616 - protein, 5 aa, Artificial Sequence
  Description of Artificial Sequence: Synthetic peptide
YAALQ

SEQ ID NO: 1617 - protein, 11 aa, Artificial Sequence
  Description of Artificial Sequence: Synthetic peptide
  MOD_RES (4)..(4): Any amino acid
SKLXRFTGCSC

SEQ ID NO: 1618 - protein, 8 aa, Artificial Sequence
  Description of Artificial Sequence: Synthetic peptide
PVKRRLFL

SEQ ID NO: 1619 - protein, 26 aa, Artificial Sequence
  Description of Artificial Sequence: Synthetic peptide
GRKRRQTSMTDFYHSKRRLIFSKRKP

SEQ ID NO: 1620 - protein, 16 aa, Artificial Sequence
  Description of Artificial Sequence: Synthetic peptide
MAGPMQTSTPKNAGKK

SEQ ID NO: 1621 - protein, 9 aa, Artificial Sequence
  Description of Artificial Sequence: Synthetic peptide
FDPPLHSTA

SEQ ID NO: 1622 - protein, 7 aa, Artificial Sequence
  Description of Artificial Sequence: Synthetic peptide
PLHSTAI

SEQ ID NO: 1623 - protein, 6 aa, Artificial Sequence
  Description of Artificial Sequence: Synthetic peptide
MDSTPL

SEQ ID NO: 1624 - protein, 7 aa, Artificial Sequence
  Description of Artificial Sequence: Synthetic peptide
FSQHKTI

SEQ ID NO: 1625 - protein, 11 aa, Artificial Sequence
  Description of Artificial Sequence: Synthetic peptide
LHYPSTTALQE

SEQ ID NO: 1626 - protein, 9 aa, Artificial Sequence
  Description of Artificial Sequence: Synthetic peptide
LLCSTPNGL

SEQ ID NO: 1627 - protein, 12 aa, Artificial Sequence
  Description of Artificial Sequence: Synthetic peptide
EAIYAAPFAKKK

SEQ ID NO: 1628 - protein, 9 aa, Artificial Sequence
  Description of Artificial Sequence: Synthetic peptide
APSYPPPPP

SEQ ID NO: 1629 - protein, 8 aa, Artificial Sequence
  Description of Artificial Sequence: Synthetic peptide
LQTIQEEE

SEQ ID NO: 1630 - protein, 4 aa, Artificial Sequence
  Description of Artificial Sequence: Synthetic peptide
SILK

SEQ ID NO: 1631 - protein, 15 aa, Artificial Sequence
  Description of Artificial Sequence: Synthetic peptide
SRRVSFADTIKVFQT

SEQ ID NO: 1632 - protein, 27 aa, Artificial Sequence
  Description of Artificial Sequence: Synthetic peptide
FSSNRQKILERTEILNQEWKQRRIQPV

SEQ ID NO: 1633 - protein, 21 aa, Artificial Sequence
  Description of Artificial Sequence: Synthetic peptide
KALETLRRVGDGVQRNHETAF

SEQ ID NO: 1634 - protein, 25 aa, Artificial Sequence
  Description of Artificial Sequence: Synthetic peptide
AELEVESATQLRRFGDKLNFRQKLL

SEQ ID NO: 1635 - protein, 21 aa, Artificial Sequence
  Description of Artificial Sequence: Synthetic peptide
  MOD_RES (8)..(8): Any amino acid
  MOD_RES (12)..(12): Any amino acid
KALETLRXVGDXVQRNHETAF

SEQ ID NO: 1636 - protein, 11 aa, Artificial Sequence
  Description of Artificial Sequence: Synthetic peptide
KEAPPAPPQDP

SEQ ID NO: 1637 - protein, 8 aa, Artificial Sequence
  Description of Artificial Sequence: Synthetic peptide
LSRRPDYR

SEQ ID NO: 1638 - protein, 14 aa, Artificial Sequence
  Description of Artificial Sequence: Synthetic peptide
RREGGMSRPADVDG

SEQ ID NO: 1639 - protein, 26 aa, Artificial Sequence
  Description of Artificial Sequence: Synthetic peptide
YRRAAVPPSPSLSRHSSPSQDEDEEE

SEQ ID NO: 1640 - protein, 9 aa, Artificial Sequence
  Description of Artificial Sequence: Synthetic peptide
SGWTVVRMY

SEQ ID NO: 1641 - protein, 8 aa, Artificial Sequence
  Description of Artificial Sequence: Synthetic peptide
REAGDGEE

SEQ ID NO: 1642 - protein, 14 aa, Artificial Sequence
  Description of Artificial Sequence: Synthetic peptide
HLQREAGDGEEFRS

SEQ ID NO: 1643 - protein, 21 aa, Artificial Sequence
  Description of Artificial Sequence: Synthetic peptide
IWIAQELRRIGDEFNAYYARR

SEQ ID NO: 1644 - protein, 16 aa, Artificial Sequence
  Description of Artificial Sequence: Synthetic peptide
GQVGRQLAIIGDDINR

SEQ ID NO: 1645 - protein, 25 aa, Artificial Sequence
  Description of Artificial Sequence: Synthetic peptide
NLWAAQRYGRELRRMSDEFVDSFKK

SEQ ID NO: 1646 - protein, 42 aa, Artificial Sequence; identical to SEQ ID NO: 1445
  Description of Artificial Sequence: Synthetic polypeptide

SEQ ID NO: 1647 - protein, 32 aa, Artificial Sequence; identical to SEQ ID NO: 1446
  Description of Artificial Sequence: Synthetic polypeptide

SEQ ID NO: 1648 - protein, 15 aa, Artificial Sequence
  Description of Artificial Sequence: Synthetic peptide
ATQLRRFGDKLNFRQ

SEQ ID NO: 1649 - protein, 20 aa, Artificial Sequence
  Description of Artificial Sequence: Synthetic peptide
EIVAKYIHYKLSQRGYEWDA

SEQ ID NO: 1650 - protein, 14 aa, Artificial Sequence
  Description of Artificial Sequence: Synthetic peptide
KKRYDREFLLGFQF

SEQ ID NO: 1651 - protein, 34 aa, Artificial Sequence; identical to SEQ ID NO: 1450
  Description of Artificial Sequence: Synthetic polypeptide

SEQ ID NO: 1652 - protein, 34 aa, Artificial Sequence; identical to SEQ ID NO: 1451
  Description of Artificial Sequence: Synthetic polypeptide

SEQ ID NO: 1653 - protein, 36 aa, Artificial Sequence; identical to SEQ ID NO: 1452
  Description of Artificial Sequence: Synthetic polypeptide

SEQ ID NO: 1654 - protein, 36 aa, Artificial Sequence; identical to SEQ ID NO: 1453
  Description of Artificial Sequence: Synthetic polypeptide

SEQ ID NO: 1655 - protein, 15 aa, Artificial Sequence
  Description of Artificial Sequence: Synthetic peptide
HIRGSITQGIPRSYV

SEQ ID NO: 1656 - protein, 9 aa, Artificial Sequence
  Description of Artificial Sequence: Synthetic peptide
GRSIHEIPR

SEQ ID NO: 1657 - protein, 21 aa, Artificial Sequence
  Description of Artificial Sequence: Synthetic peptide
GLVATVKEAGRSIHEIPREEL

SEQ ID NO: 1658 - protein, 12 aa, Artificial Sequence
  Description of Artificial Sequence: Synthetic peptide
KDYEEVGVDSVE

SEQ ID NO: 1659 - protein, 13 aa, Artificial Sequence
  Description of Artificial Sequence: Synthetic peptide
YQQYQDATADEQG

SEQ ID NO: 1660 - protein, 20 aa, Artificial Sequence
  Description of Artificial Sequence: Synthetic peptide
DAVRRIEDMMNQARHASSGV

SEQ ID NO: 1661 - protein, 13 aa, Artificial Sequence
  Description of Artificial Sequence: Synthetic peptide
YVYNTRSGWRWYT

SEQ ID NO: 1662 - protein, 17 aa, Artificial Sequence
  Description of Artificial Sequence: Synthetic peptide
VRKRTLRRLLQERELVE

SEQ ID NO: 1663 - protein, 28 aa, Artificial Sequence
  Description of Artificial Sequence: Synthetic peptide
RQVRELENYIDRLVRVMEETPNILRIPR

SEQ ID NO: 1664 - protein, 7 aa, Artificial Sequence
  Description of Artificial Sequence: Synthetic peptide
KKSRALF

SEQ ID NO: 1665 - protein, 12 aa, Artificial Sequence
  Description of Artificial Sequence: Synthetic peptide
RCLSSSAVANRS

SEQ ID NO: 1666 - protein, 12 aa, Artificial Sequence
  Description of Artificial Sequence: Synthetic peptide
RSLSSSAVANRS

SEQ ID NO: 1667 - protein, 13 aa, Artificial Sequence
  Description of Artificial Sequence: Synthetic peptide
AVANRSKKSRALF

SEQ ID NO: 1668 - protein, 19 aa, Artificial Sequence
  Description of Artificial Sequence: Synthetic peptide
RCESSSAEANRSKKERELF

SEQ ID NO: 1669 - protein, 13 aa, Artificial Sequence
  Description of Artificial Sequence: Synthetic peptide
ASSESQRYVYSIL

SEQ ID NO: 1670 - protein, 13 aa, Artificial Sequence
  Description of Artificial Sequence: Synthetic peptide
ASSASQEYVYSIL

SEQ ID NO: 1671 - protein, 18 aa, Artificial Sequence
  Description of Artificial Sequence: Synthetic peptide
RSSAMDENSEKKRKSAIK

SEQ ID NO: 1672 - protein, 14 aa, Artificial Sequence
  Description of Artificial Sequence: Synthetic peptide
GDENSEKKRKQAIK

SEQ ID NO: 1673 - protein, 10 aa, Artificial Sequence
  Description of Artificial Sequence: Synthetic peptide
SGRRYGHALR

SEQ ID NO: 1674 - protein, 10 aa, Artificial Sequence
  Description of Artificial Sequence: Synthetic peptide
ATGAPRLPST

SEQ ID NO: 1675 - protein, 10 aa, Artificial Sequence
  Description of Artificial Sequence: Synthetic peptide
RLAHGYRRGS

SEQ ID NO: 1676 - protein, 13 aa, Artificial Sequence
  Description of Artificial Sequence: Synthetic peptide
RTLFKAHMGQKHR

SEQ ID NO: 1677 - protein, 10 aa, Artificial Sequence
  Description of Artificial Sequence: Synthetic peptide
YSRVGRSVTD

SEQ ID NO: 1678 - protein, 12 aa, Artificial Sequence
  Description of Artificial Sequence: Synthetic peptide
HSKGHQKRKALK

SEQ ID NO: 1679 - protein, 12 aa, Artificial Sequence
  Description of Artificial Sequence: Synthetic peptide
MGYQKKLRSMTD

SEQ ID NO: 1680 - protein, 16 aa, Artificial Sequence
  Description of Artificial Sequence: Synthetic peptide
MGYQKKLRSMTDKYRL

SEQ ID NO: 1681 - protein, 10 aa, Artificial Sequence
  Description of Artificial Sequence: Synthetic peptide
GMRPYDANKR

SEQ ID NO: 1682 - protein, 7 aa, Artificial Sequence
  Description of Artificial Sequence: Synthetic peptide
GRPYDAN

SEQ ID NO: 1683 - protein, 16 aa, Artificial Sequence
  Description of Artificial Sequence: Synthetic peptide
KIHKKGMIKSSRPLRV

SEQ ID NO: 1684 - protein, 10 aa, Artificial Sequence
  Description of Artificial Sequence: Synthetic peptide
KIHKKGMIKS

SEQ ID NO: 1685 - protein, 12 aa, Artificial Sequence
  Description of Artificial Sequence: Synthetic peptide
KIHKKGMIKSSR

SEQ ID NO: 1686 - protein, 16 aa, Artificial Sequence
  Description of Artificial Sequence: Synthetic peptide
KRKALKALILNEKKVQ

SEQ ID NO: 1687 - protein, 12 aa, Artificial Sequence
  Description of Artificial Sequence: Synthetic peptide
TFVADWRNSNRY

SEQ ID NO: 1688 - protein, 23 aa, Artificial Sequence
  Description of Artificial Sequence: Synthetic peptide
TWAWHTSFKALGTTYQPLSGKTS

SEQ ID NO: 1689 - protein, 31 aa, Artificial Sequence; identical to SEQ ID NO: 1488
  Description of Artificial Sequence: Synthetic polypeptide

SEQ ID NO: 1690 - protein, 12 aa, Artificial Sequence
  Description of Artificial Sequence: Synthetic peptide
RNNSRLGNGVLY

SEQ ID NO: 1691 - protein, 10 aa, Artificial Sequence
  Description of Artificial Sequence: Synthetic peptide
RRERRDLFTE

SEQ ID NO: 1692 - protein, 12 aa, Artificial Sequence
  Description of Artificial Sequence: Synthetic peptide
MGETVNKIAQES

SEQ ID NO: 1693 - protein, 11 aa, Artificial Sequence
  Description of Artificial Sequence: Synthetic peptide
RASQYFSSYLA

SEQ ID NO: 1694 - protein, 16 aa, Artificial Sequence
  Description of Artificial Sequence: Synthetic peptide
AREDFRNRRLWYVMDY

SEQ ID NO: 1695 - protein, 13 aa, Artificial Sequence
  Description of Artificial Sequence: Synthetic peptide
KASGYSFTDYFIY

SEQ ID NO: 1696 - protein, 8 aa, Artificial Sequence
  Description of Artificial Sequence: Synthetic peptide
YRDRRRPS

SEQ ID NO: 1697 - protein, 13 aa, Artificial Sequence
  Description of Artificial Sequence: Synthetic peptide
SGSSSDIGSNYVS

SEQ ID NO: 1698 - protein, 9 aa, Artificial Sequence
  Description of Artificial Sequence: Synthetic peptide
QQWSSHIFT

SEQ ID NO: 1699 - protein, 14 aa, Artificial Sequence
  Description of Artificial Sequence: Synthetic peptide
ASRDYDYAGRYFDY

SEQ ID NO: 1700 - protein, 9 aa, Artificial Sequence
  Description of Artificial Sequence: Synthetic peptide
QNGHSFPFT

SEQ ID NO: 1701 - protein, 10 aa, Artificial Sequence
  Description of Artificial Sequence: Synthetic peptide
YINPYNDGTK

SEQ ID NO: 1702 - protein, 8 aa, Artificial Sequence
  Description of Artificial Sequence: Synthetic peptide
ARNWDVAY

SEQ ID NO: 1703 - protein, 11 aa, Artificial Sequence
  Description of Artificial Sequence: Synthetic peptide
SGYSFTGHWMN

SEQ ID NO: 1704 - protein, 10 aa, Artificial Sequence
  Description of Artificial Sequence: Synthetic peptide
MIHPSDSETR

SEQ ID NO: 1705 - protein, 14 aa, Artificial Sequence
  Description of Artificial Sequence: Synthetic peptide
ARGIYFYGTTYFDY

SEQ ID NO: 1706 - protein, 10 aa, Artificial Sequence
  Description of Artificial Sequence: Synthetic peptide
SGFSFTSSVS

SEQ ID NO: 1707 - protein, 9 aa, Artificial Sequence
  Description of Artificial Sequence: Synthetic peptide
LIYPYNGFN

SEQ ID NO: 1708 - protein, 13 aa, Artificial Sequence
  Description of Artificial Sequence: Synthetic peptide
AASGFTFTSTGIS

SEQ ID NO: 1709 - protein, 15 aa, Artificial Sequence
  Description of Artificial Sequence: Synthetic peptide
ARTYGIYDLYVDYTE

SEQ ID NO: 1710 - protein, 9 aa, Artificial Sequence
  Description of Artificial Sequence: Synthetic peptide
SRDYGYYFD

SEQ ID NO: 1711 - protein, 10 aa, Artificial Sequence
  Description of Artificial Sequence: Synthetic peptide
GYSFTRYWMH

SEQ ID NO: 1712 - protein, 8 aa, Artificial Sequence
  Description of Artificial Sequence: Synthetic peptide
QWWWWPST

SEQ ID NO: 1713 - protein, 12 aa, Artificial Sequence
  Description of Artificial Sequence: Synthetic peptide
ASGFSIWWSWIH

SEQ ID NO: 1714 - protein, 8 aa, Artificial Sequence
  Description of Artificial Sequence: Synthetic peptide
YDNNQRPS

SEQ ID NO: 1715 - protein, 17 aa, Artificial Sequence
  Description of Artificial Sequence: Synthetic peptide
TFHIRRYRSGYYDKMDH

SEQ ID NO: 1716 - protein, 12 aa, Artificial Sequence
  Description of Artificial Sequence: Synthetic peptide
ARGPFSPWVMDY

SEQ ID NO: 1717 - protein, 9 aa, Artificial Sequence
  Description of Artificial Sequence: Synthetic peptide
TRHDGTNFD

SEQ ID NO: 1718 - protein, 9 aa, Artificial Sequence
  Description of Artificial Sequence: Synthetic peptide
QQAKAFPPT

SEQ ID NO: 1719 - protein, 12 aa, Artificial Sequence
  Description of Artificial Sequence: Synthetic peptide
SGHVNAVKNYGY

SEQ ID NO: 1720 - protein, 8 aa, Artificial Sequence
  Description of Artificial Sequence: Synthetic peptide
WINTETGS

SEQ ID NO: 1721 - protein, 8 aa, Artificial Sequence
  Description of Artificial Sequence: Synthetic peptide
WINTYTGE

SEQ ID NO: 1722 - protein, 10 aa, Artificial Sequence
  Description of Artificial Sequence: Synthetic peptide
GYTFTNYGMN

SEQ ID NO: 1723 - protein, 11 aa, Artificial Sequence
  Description of Artificial Sequence: Synthetic peptide
KEAPPAPPQDP

SEQ ID NO: 1724 - protein, 8 aa, Artificial Sequence
  Description of Artificial Sequence: Synthetic peptide
LSRRPDYR

SEQ ID NO: 1725 - protein, 14 aa, Artificial Sequence
  Description of Artificial Sequence: Synthetic peptide
RREGGMSRPADVDG

SEQ ID NO: 1726 - protein, 26 aa, Artificial Sequence
  Description of Artificial Sequence: Synthetic peptide
YRRAAVPPSPSLSRHSSPSQDEDEEE

SEQ ID NO: 1727 - protein, 19 aa, Artificial Sequence
  Description of Artificial Sequence: Synthetic peptide
GAYPEYILDIHVYRVQLEL

SEQ ID NO: 1728 - protein, 22 aa, Artificial Sequence
  Description of Artificial Sequence: Synthetic peptide
SQEQLEHRYRSLITLYDIQLML

SEQ ID NO: 1729 - protein, 19 aa, Artificial Sequence
  Description of Artificial Sequence: Synthetic peptide
QELGDNDELMHFSYESTQD

SEQ ID NO: 1730 - protein, 16 aa, Artificial Sequence
  Description of Artificial Sequence: Synthetic peptide
YAYQRAIVEYMLRLMS

SEQ ID NO: 1731 - protein, 14 aa, Artificial Sequence
  Description of Artificial Sequence: Synthetic peptide
YEQAIAAYLDALMC

SEQ ID NO: 1732 - protein, 16 aa, Artificial Sequence
  Description of Artificial Sequence: Synthetic peptide
SCSEELEALEALELDE

SEQ ID NO: 1733 - protein, 31 aa, Artificial Sequence; identical to SEQ ID NO: 1327
  Description of Artificial Sequence: Synthetic polypeptide

SEQ ID NO: 1734 - protein, 20 aa, Artificial Sequence
  Description of Artificial Sequence: Synthetic peptide
RTLTVERLLEPLVTQVTTLV

SEQ ID NO: 1735 - protein, 57 aa, Artificial Sequence; identical to SEQ ID NO: 1329
  Description of Artificial Sequence: Synthetic polypeptide

SEQ ID NO: 1736 - protein, 9 aa, Artificial Sequence
  Description of Artificial Sequence: Synthetic peptide
  MOD_RES (2)..(3): Any amino acid
DXXEFDQYL

SEQ ID NO: 1737 - protein, 33 aa, Artificial Sequence; identical to SEQ ID NO: 1331
  Description of Artificial Sequence: Synthetic polypeptide

SEQ ID NO: 1738 - protein, 15 aa, Artificial Sequence
  Description of Artificial Sequence: Synthetic peptide
FEGIALTNYLKALEG

SEQ ID NO: 1739 - protein, 6 aa, Artificial Sequence
  Description of Artificial Sequence: Synthetic peptide
PLYISY

SEQ ID NO: 1740 - protein, 19 aa, Artificial Sequence
  Description of Artificial Sequence: Synthetic peptide
SIEDLHEYWARLWNYLYVA

SEQ ID NO: 1741 - protein, 20 aa, Artificial Sequence
  Description of Artificial Sequence: Synthetic peptide
QASLEELHEYWARLWNYRVA

SEQ ID NO: 1742 - protein, 22 aa, Artificial Sequence
  Description of Artificial Sequence: Synthetic peptide
NASIKQLHAYWQRLYAYLAAVA

SEQ ID NO: 1743 - protein, 12 aa, Artificial Sequence
  Description of Artificial Sequence: Synthetic peptide
CMWWREICPVWW

SEQ ID NO: 1744 - protein, 11 aa, Artificial Sequence
  Description of Artificial Sequence: Synthetic peptide
FARKTFLKLAF

SEQ ID NO: 1745 - protein, 10 aa, Artificial Sequence
  Description of Artificial Sequence: Synthetic peptide
ARRFFLDIAD

SEQ ID NO: 1746 - protein, 10 aa, Artificial Sequence
  Description of Artificial Sequence: Synthetic peptide
  MOD_RES (5)..(6): Any amino acid
  MOD_RES (9)..(10): Any amino acid
FRWPXXRLXX

SEQ ID NO: 1747 - protein, 8 aa, Artificial Sequence
  Description of Artificial Sequence: Synthetic peptide
  MOD_RES (1)..(1): A, C, D, E, G, H, K, N, Q, R, S, or T
  MOD_RES (2)..(2): A, C, D, E, F, G, H, I, K, L, M, N, P, Q, R, S, T, V, W, or Y
  MOD_RES (5)..(5): Any amino acid
  MOD_RES (6)..(6): A, C, F, G, H, I, K, L, M, R, T, V, W, or Y
  MOD_RES (7)..(7): A, C, D, E, F, G, H, I, K, L, M, N, P, Q, R, S, T, V, W, or Y
  MOD_RES (8)..(8): C, D, E, H, K, N, Q, R, S, or T
XXVFXXXX

SEQ ID NO: 1748 - protein, 9 aa, Artificial Sequence
  Description of Artificial Sequence: Synthetic peptide
YGHGQVYYY

SEQ ID NO: 1749 - protein, 6 aa, Artificial Sequence
  Description of Artificial Sequence: Synthetic peptide
ENPKQN

SEQ ID NO: 1750 - protein, 12 aa, Artificial Sequence
  Description of Artificial Sequence: Synthetic peptide
DAYECLDASRPW

SEQ ID NO: 1751 - protein, 7 aa, Artificial Sequence
  Description of Artificial Sequence: Synthetic peptide
KSRDFYH

SEQ ID NO: 1752 - protein, 16 aa, Artificial Sequence
  Description of Artificial Sequence: Synthetic peptide
AGVEHQLRREVEIQSH

SEQ ID NO: 1753 - protein, 25 aa, Artificial Sequence
  Description of Artificial Sequence: Synthetic peptide
WSVHAPSSRRTTLAGTLDYLPPEMI

SEQ ID NO: 1754 - protein, 6 aa, Artificial Sequence
  Description of Artificial Sequence: Synthetic peptide
TYQETY

SEQ ID NO: 1755 - protein, 32 aa, Artificial Sequence; identical to SEQ ID NO: 1349
  Description of Artificial Sequence: Synthetic polypeptide

SEQ ID NO: 1756 - protein, 14 aa, Artificial Sequence
  Description of Artificial Sequence: Synthetic peptide
NELKRSFAALRDQI

SEQ ID NO: 1757 - protein, 14 aa, Artificial Sequence
  Description of Artificial Sequence: Synthetic peptide
NELKRAFAALRDQI

SEQ ID NO: 1758 - protein, 29 aa, Artificial Sequence
  Description of Artificial Sequence: Synthetic peptide
IREKNHYHRQEVDDLRRQNALLEQQVRAL

SEQ ID NO: 1759 - protein, 11 aa, Artificial Sequence
  Description of Artificial Sequence: Synthetic peptide
FNHITNASQWE

SEQ ID NO: 1760 - protein, 11 aa, Artificial Sequence
  Description of Artificial Sequence: Synthetic peptide
GDLGAFSRGQM

SEQ ID NO: 1761 - protein, 17 aa, Artificial Sequence
  Description of Artificial Sequence: Synthetic peptide
RSEFYYYGNTYYYSAMD

SEQ ID NO: 1762 - protein, 9 aa, Artificial Sequence
  Description of Artificial Sequence: Synthetic peptide
QHDYTATDE

SEQ ID NO: 1763 - protein, 10 aa, Artificial Sequence
  Description of Artificial Sequence: Synthetic peptide
QNPEEQDEGW

SEQ ID NO: 1764 - protein, 11 aa, Artificial Sequence
  Description of Artificial Sequence: Synthetic peptide
EKCRGVFPENF

SEQ ID NO: 1765 - protein, 13 aa, Artificial Sequence
  Description of Artificial Sequence: Synthetic peptide
KWTLERLKRKYRN

SEQ ID NO: 1766 - protein, 17 aa, Artificial Sequence
  Description of Artificial Sequence: Synthetic peptide
TWRVQRSQNPLKIRLTR

SEQ ID NO: 1767 - protein, 12 aa, Artificial Sequence
  Description of Artificial Sequence: Synthetic peptide
TMRGKKKRTRAN

SEQ ID NO: 1768 - protein, 15 aa, Artificial Sequence
  Description of Artificial Sequence: Synthetic peptide
SYSYDAPSDFINFSS

SEQ ID NO: 1769 - protein, 37 aa, Artificial Sequence; identical to SEQ ID NO: 1401
  Description of Artificial Sequence: Synthetic polypeptide

SEQ ID NO: 1770 - protein, 24 aa, Artificial Sequence
  Description of Artificial Sequence: Synthetic peptide
MSQVKSSYSYDAPSDFINFSSLDD

SEQ ID NO: 1771 - protein, 31 aa, Artificial Sequence; identical to SEQ ID NO: 1403
  Description of Artificial Sequence: Synthetic polypeptide

SEQ ID NO: 1772 - protein, 29 aa, Artificial Sequence
  Description of Artificial Sequence: Synthetic peptide
LEFDSLQPCFYPDEDDFYFGGPDSTPPGE

SEQ ID NO: 1773 - protein, 15 aa, Artificial Sequence
  Description of Artificial Sequence: Synthetic peptide
RLYGFKIHPMAYQLQ

SEQ ID NO: 1774 - protein, 19 aa, Artificial Sequence
  Description of Artificial Sequence: Synthetic peptide
EPPLNPHGSARAEVHLRKS

SEQ ID NO: 1775 - protein, 20 aa, Artificial Sequence
  Description of Artificial Sequence: Synthetic peptide
SAVMERLRRRIELCRRHHST

SEQ ID NO: 1776 - protein, 22 aa, Artificial Sequence
  Description of Artificial Sequence: Synthetic peptide
TYTKKQVLRMEHLVLKVLTFDL

SEQ ID NO: 1777 - protein, 20 aa, Artificial Sequence
  Description of Artificial Sequence: Synthetic peptide
LVCKSYRLDWEAGALFRSLF

SEQ ID NO: 1778 - protein, 20 aa, Artificial Sequence
  Description of Artificial Sequence: Synthetic peptide
YSFVHHGFFNFRVSWREMLA

SEQ ID NO: 1779 - protein, 5 aa, Artificial Sequence
  Description of Artificial Sequence: Synthetic peptide
TAALS

SEQ ID NO: 1780 - protein, 5 aa, Artificial Sequence
  Description of Artificial Sequence: Synthetic peptide
TALLS

SEQ ID NO: 1781 - protein, 5 aa, Artificial Sequence
  Description of Artificial Sequence: Synthetic peptide
LAALS

SEQ ID NO: 1782 - protein, 5 aa, Artificial Sequence
  Description of Artificial Sequence: Synthetic peptide
DAALT

SEQ ID NO: 1783 - protein, 5 aa, Artificial Sequence
  Description of Artificial Sequence: Synthetic peptide
YAALQ

SEQ ID NO: 1784 - protein, 11 aa, Artificial Sequence
  Description of Artificial Sequence: Synthetic peptide
  MOD_RES (4)..(4): Any amino acid
SKLXRFTGCSC

SEQ ID NO: 1785 - protein, 8 aa, Artificial Sequence
  Description of Artificial Sequence: Synthetic peptide
PVKRRLFL

SEQ ID NO: 1786 - protein, 26 aa, Artificial Sequence
  Description of Artificial Sequence: Synthetic peptide
GRKRRQTSMTDFYHSKRRLIFSKRKP

SEQ ID NO: 1787 - protein, 16 aa, Artificial Sequence
  Description of Artificial Sequence: Synthetic peptide
MAGPMQTSTPKNAGKK

SEQ ID NO: 1788 - protein, 9 aa, Artificial Sequence
  Description of Artificial Sequence: Synthetic peptide
FDPPLHSTA

SEQ ID NO: 1789 - protein, 7 aa, Artificial Sequence
  Description of Artificial Sequence: Synthetic peptide
PLHSTAI

SEQ ID NO: 1790 - protein, 6 aa, Artificial Sequence
  Description of Artificial Sequence: Synthetic peptide
MDSTPL

SEQ ID NO: 1791 - protein, 7 aa, Artificial Sequence
  Description of Artificial Sequence: Synthetic peptide
FSQHKTI

SEQ ID NO: 1792 - protein, 11 aa, Artificial Sequence
  Description of Artificial Sequence: Synthetic peptide
LHYPSTTALQE

SEQ ID NO: 1793 - protein, 9 aa, Artificial Sequence
  Description of Artificial Sequence: Synthetic peptide
LLCSTPNGL

SEQ ID NO: 1794 - protein, 12 aa, Artificial Sequence
  Description of Artificial Sequence: Synthetic peptide
EAIYAAPFAKKK

SEQ ID NO: 1795 - protein, 9 aa, Artificial Sequence
  Description of Artificial Sequence: Synthetic peptide
APSYPPPPP

SEQ ID NO: 1796 - protein, 8 aa, Artificial Sequence
  Description of Artificial Sequence: Synthetic peptide
LQTIQEEE

SEQ ID NO: 1797 - protein, 4 aa, Artificial Sequence
  Description of Artificial Sequence: Synthetic peptide
SILK

SEQ ID NO: 1798 - protein, 15 aa, Artificial Sequence
  Description of Artificial Sequence: Synthetic peptide
SRRVSFADTIKVFQT

SEQ ID NO: 1799 - protein, 27 aa, Artificial Sequence
  Description of Artificial Sequence: Synthetic peptide
FSSNRQKILERTEILNQEWKQRRIQPV

SEQ ID NO: 1800 - protein, 21 aa, Artificial Sequence
  Description of Artificial Sequence: Synthetic peptide
KALETLRRVGDGVQRNHETAF

SEQ ID NO: 1801 - protein, 25 aa, Artificial Sequence
  Description of Artificial Sequence: Synthetic peptide
AELEVESATQLRRFGDKLNFRQKLL

SEQ ID NO: 1802 - protein, 21 aa, Artificial Sequence
  Description of Artificial Sequence: Synthetic peptide
  MOD_RES (8)..(8): Any amino acid
  MOD_RES (12)..(12): Any amino acid
KALETLRXVGDXVQRNHETAF

SEQ ID NO: 1803 - protein, 11 aa, Artificial Sequence
  Description of Artificial Sequence: Synthetic peptide
KEAPPAPPQDP

SEQ ID NO: 1804 - protein, 8 aa, Artificial Sequence
  Description of Artificial Sequence: Synthetic peptide
LSRRPDYR

SEQ ID NO: 1805 - protein, 14 aa, Artificial Sequence
  Description of Artificial Sequence: Synthetic peptide
RREGGMSRPADVDG

SEQ ID NO: 1806 - protein, 26 aa, Artificial Sequence
  Description of Artificial Sequence: Synthetic peptide
YRRAAVPPSPSLSRHSSPSQDEDEEE

SEQ ID NO: 1807 - protein, 9 aa, Artificial Sequence
  Description of Artificial Sequence: Synthetic peptide
SGWTVVRMY

SEQ ID NO: 1808 - protein, 8 aa, Artificial Sequence
  Description of Artificial Sequence: Synthetic peptide
REAGDGEE

SEQ ID NO: 1809 - protein, 14 aa, Artificial Sequence
  Description of Artificial Sequence: Synthetic peptide
HLQREAGDGEEFRS

SEQ ID NO: 1810 - protein, 21 aa, Artificial Sequence
  Description of Artificial Sequence: Synthetic peptide
IWIAQELRRIGDEFNAYYARR

SEQ ID NO: 1811 - protein, 16 aa, Artificial Sequence
  Description of Artificial Sequence: Synthetic peptide
GQVGRQLAIIGDDINR

SEQ ID NO: 1812 - protein, 25 aa, Artificial Sequence
  Description of Artificial Sequence: Synthetic peptide
NLWAAQRYGRELRRMSDEFVDSFKK

SEQ ID NO: 1813 - protein, 42 aa, Artificial Sequence; identical to SEQ ID NO: 1445
  Description of Artificial Sequence: Synthetic polypeptide

SEQ ID NO: 1814 - protein, 32 aa, Artificial Sequence; identical to SEQ ID NO: 1446
  Description of Artificial Sequence: Synthetic polypeptide

SEQ ID NO: 1815 - protein, 15 aa, Artificial Sequence
  Description of Artificial Sequence: Synthetic peptide
ATQLRRFGDKLNFRQ

SEQ ID NO: 1816 - protein, 20 aa, Artificial Sequence
  Description of Artificial Sequence: Synthetic peptide
EIVAKYIHYKLSQRGYEWDA

SEQ ID NO: 1817 - protein, 14 aa, Artificial Sequence
  Description of Artificial Sequence: Synthetic peptide
KKRYDREFLLGFQF

SEQ ID NO: 1818 - protein, 34 aa, Artificial Sequence; identical to SEQ ID NO: 1450
  Description of Artificial Sequence: Synthetic polypeptide

SEQ ID NO: 1819 - protein, 34 aa, Artificial Sequence; identical to SEQ ID NO: 1451
  Description of Artificial Sequence: Synthetic polypeptide

SEQ ID NO: 1820 - protein, 36 aa, Artificial Sequence; identical to SEQ ID NO: 1452
  Description of Artificial Sequence: Synthetic polypeptide

SEQ ID NO: 1821 - protein, 36 aa, Artificial Sequence; identical to SEQ ID NO: 1453
  Description of Artificial Sequence: Synthetic polypeptide

SEQ ID NO: 1822 - protein, 15 aa, Artificial Sequence
  Description of Artificial Sequence: Synthetic peptide
HIRGSITQGIPRSYV

SEQ ID NO: 1823 - protein, 9 aa, Artificial Sequence
  Description of Artificial Sequence: Synthetic peptide
GRSIHEIPR

SEQ ID NO: 1824 - protein, 21 aa, Artificial Sequence
  Description of Artificial Sequence: Synthetic peptide
GLVATVKEAGRSIHEIPREEL

SEQ ID NO: 1825 - protein, 12 aa, Artificial Sequence
  Description of Artificial Sequence: Synthetic peptide
KDYEEVGVDSVE

SEQ ID NO: 1826 - protein, 13 aa, Artificial Sequence
  Description of Artificial Sequence: Synthetic peptide
YQQYQDATADEQG

SEQ ID NO: 1827 - protein, 20 aa, Artificial Sequence
  Description of Artificial Sequence: Synthetic peptide
DAVRRIEDMMNQARHASSGV

SEQ ID NO: 1828 - protein, 13 aa, Artificial Sequence
  Description of Artificial Sequence: Synthetic peptide
YVYNTRSGWRWYT

SEQ ID NO: 1829 - protein, 17 aa, Artificial Sequence
  Description of Artificial Sequence: Synthetic peptide
VRKRTLRRLLQERELVE

SEQ ID NO: 1830 - protein, 28 aa, Artificial Sequence
  Description of Artificial Sequence: Synthetic peptide
RQVRELENYIDRLVRVMEETPNILRIPR

SEQ ID NO: 1831 - protein, 7 aa, Artificial Sequence
  Description of Artificial Sequence: Synthetic peptide
KKSRALF

SEQ ID NO: 1832 - protein, 12 aa, Artificial Sequence
  Description of Artificial Sequence: Synthetic peptide
RCLSSSAVANRS

SEQ ID NO: 1833 - protein, 12 aa, Artificial Sequence
  Description of Artificial Sequence: Synthetic peptide
RSLSSSAVANRS

SEQ ID NO: 1834 - protein, 13 aa, Artificial Sequence
  Description of Artificial Sequence: Synthetic peptide
AVANRSKKSRALF

SEQ ID NO: 1835 - protein, 19 aa, Artificial Sequence
  Description of Artificial Sequence: Synthetic peptide
RCESSSAEANRSKKERELF

SEQ ID NO: 1836 - protein, 13 aa, Artificial Sequence
  Description of Artificial Sequence: Synthetic peptide
ASSESQRYVYSIL

SEQ ID NO: 1837 - protein, 13 aa, Artificial Sequence
  Description of Artificial Sequence: Synthetic peptide
ASSASQEYVYSIL

SEQ ID NO: 1838 - protein, 18 aa, Artificial Sequence
  Description of Artificial Sequence: Synthetic peptide
RSSAMDENSEKKRKSAIK

SEQ ID NO: 1839 - protein, 14 aa, Artificial Sequence
  Description of Artificial Sequence: Synthetic peptide
GDENSEKKRKQAIK

SEQ ID NO: 1840 - protein, 10 aa, Artificial Sequence
  Description of Artificial Sequence: Synthetic peptide
SGRRYGHALR

SEQ ID NO: 1841 - protein, 10 aa, Artificial Sequence
  Description of Artificial Sequence: Synthetic peptide
ATGAPRLPST

SEQ ID NO: 1842 - protein, 10 aa, Artificial Sequence
  Description of Artificial Sequence: Synthetic peptide
RLAHGYRRGS

SEQ ID NO: 1843 - protein, 13 aa, Artificial Sequence
  Description of Artificial Sequence: Synthetic peptide
RTLFKAHMGQKHR

SEQ ID NO: 1844 - protein, 10 aa, Artificial Sequence
  Description of Artificial Sequence: Synthetic peptide
YSRVGRSVTD

SEQ ID NO: 1845 - protein, 12 aa, Artificial Sequence
  Description of Artificial Sequence: Synthetic peptide
HSKGHQKRKALK

SEQ ID NO: 1846 - protein, 12 aa, Artificial Sequence
  Description of Artificial Sequence: Synthetic peptide
MGYQKKLRSMTD

SEQ ID NO: 1847 - protein, 16 aa, Artificial Sequence
  Description of Artificial Sequence: Synthetic peptide
MGYQKKLRSMTDKYRL

SEQ ID NO: 1848 - protein, 10 aa, Artificial Sequence
  Description of Artificial Sequence: Synthetic peptide
GMRPYDANKR

SEQ ID NO: 1849 - protein, 7 aa, Artificial Sequence
  Description of Artificial Sequence: Synthetic peptide
GRPYDAN

SEQ ID NO: 1850 - protein, 16 aa, Artificial Sequence
  Description of Artificial Sequence: Synthetic peptide
KIHKKGMIKSSRPLRV

SEQ ID NO: 1851 - protein, 10 aa, Artificial Sequence
  Description of Artificial Sequence: Synthetic peptide
KIHKKGMIKS

SEQ ID NO: 1852 - protein, 12 aa, Artificial Sequence
  Description of Artificial Sequence: Synthetic peptide
KIHKKGMIKSSR

SEQ ID NO: 1853 - protein, 16 aa, Artificial Sequence
  Description of Artificial Sequence: Synthetic peptide
KRKALKALILNEKKVQ

SEQ ID NO: 1854 - protein, 12 aa, Artificial Sequence
  Description of Artificial Sequence: Synthetic peptide
TFVADWRNSNRY

SEQ ID NO: 1855 - protein, 23 aa, Artificial Sequence
  Description of Artificial Sequence: Synthetic peptide
TWAWHTSFKALGTTYQPLSGKTS

SEQ ID NO: 1856 - protein, 31 aa, Artificial Sequence; identical to SEQ ID NO: 1488
  Description of Artificial Sequence: Synthetic polypeptide

SEQ ID NO: 1857 - protein, 12 aa, Artificial Sequence
  Description of Artificial Sequence: Synthetic peptide
RNNSRLGNGVLY

SEQ ID NO: 1858 - protein, 10 aa, Artificial Sequence
  Description of Artificial Sequence: Synthetic peptide
RRERRDLFTE

SEQ ID NO: 1859 - protein, 12 aa, Artificial Sequence
  Description of Artificial Sequence: Synthetic peptide
MGETVNKIAQES

SEQ ID NO: 1860 - protein, 11 aa, Artificial Sequence
  Description of Artificial Sequence: Synthetic peptide
RASQYFSSYLA

SEQ ID NO: 1861 - protein, 16 aa, Artificial Sequence
  Description of Artificial Sequence: Synthetic peptide
AREDFRNRRLWYVMDY

SEQ ID NO: 1862 - protein, 13 aa, Artificial Sequence
  Description of Artificial Sequence: Synthetic peptide
KASGYSFTDYFIY

SEQ ID NO: 1863 - protein, 8 aa, Artificial Sequence
  Description of Artificial Sequence: Synthetic peptide
YRDRRRPS

SEQ ID NO: 1864 - protein, 13 aa, Artificial Sequence
  Description of Artificial Sequence: Synthetic peptide
SGSSSDIGSNYVS

SEQ ID NO: 1865 - protein, 9 aa, Artificial Sequence
  Description of Artificial Sequence: Synthetic peptide
QQWSSHIFT

SEQ ID NO: 1866 - protein, 14 aa, Artificial Sequence
  Description of Artificial Sequence: Synthetic peptide
ASRDYDYAGRYFDY

SEQ ID NO: 1867 - protein, 9 aa, Artificial Sequence
  Description of Artificial Sequence: Synthetic peptide
QNGHSFPFT

SEQ ID NO: 1868 - protein, 10 aa, Artificial Sequence
  Description of Artificial Sequence: Synthetic peptide
YINPYNDGTK

SEQ ID NO: 1869 - protein, 8 aa, Artificial Sequence
  Description of Artificial Sequence: Synthetic peptide
ARNWDVAY

SEQ ID NO: 1870 - protein, 11 aa, Artificial Sequence
  Description of Artificial Sequence: Synthetic peptide
SGYSFTGHWMN

SEQ ID NO: 1871 - protein, 10 aa, Artificial Sequence
  Description of Artificial Sequence: Synthetic peptide
MIHPSDSETR

SEQ ID NO: 1872 - protein, 14 aa, Artificial Sequence
  Description of Artificial Sequence: Synthetic peptide
ARGIYFYGTTYFDY

SEQ ID NO: 1873 - protein, 10 aa, Artificial Sequence
  Description of Artificial Sequence: Synthetic peptide
SGFSFTSSVS

SEQ ID NO: 1874 - protein, 9 aa, Artificial Sequence
  Description of Artificial Sequence: Synthetic peptide
LIYPYNGFN

SEQ ID NO: 1875 - protein, 13 aa, Artificial Sequence
  Description of Artificial Sequence: Synthetic peptide
AASGFTFTSTGIS

SEQ ID NO: 1876 - protein, 15 aa, Artificial Sequence
  Description of Artificial Sequence: Synthetic peptide
ARTYGIYDLYVDYTE

SEQ ID NO: 1877 - protein, 9 aa, Artificial Sequence
  Description of Artificial Sequence: Synthetic peptide
SRDYGYYFD

SEQ ID NO: 1878 - protein, 10 aa, Artificial Sequence
  Description of Artificial Sequence: Synthetic peptide
GYSFTRYWMH

SEQ ID NO: 1879 - protein, 8 aa, Artificial Sequence
  Description of Artificial Sequence: Synthetic peptide
QWWWWPST

SEQ ID NO: 1880 - protein, 12 aa, Artificial Sequence
  Description of Artificial Sequence: Synthetic peptide
ASGFSIWWSWIH

SEQ ID NO: 1881 - protein, 8 aa, Artificial Sequence
  Description of Artificial Sequence: Synthetic peptide
YDNNQRPS

SEQ ID NO: 1882 - protein, 17 aa, Artificial Sequence
  Description of Artificial Sequence: Synthetic peptide
TFHIRRYRSGYYDKMDH

SEQ ID NO: 1883 - protein, 12 aa, Artificial Sequence
  Description of Artificial Sequence: Synthetic peptide
ARGPFSPWVMDY

SEQ ID NO: 1884 - protein, 9 aa, Artificial Sequence
  Description of Artificial Sequence: Synthetic peptide
TRHDGTNFD

SEQ ID NO: 1885 - protein, 9 aa, Artificial Sequence
  Description of Artificial Sequence: Synthetic peptide
QQAKAFPPT

SEQ ID NO: 1886 - protein, 12 aa, Artificial Sequence
  Description of Artificial Sequence: Synthetic peptide
SGHVNAVKNYGY

SEQ ID NO: 1887 - protein, 8 aa, Artificial Sequence
  Description of Artificial Sequence: Synthetic peptide
WINTETGS

SEQ ID NO: 1888 - protein, 8 aa, Artificial Sequence
  Description of Artificial Sequence: Synthetic peptide
WINTYTGE

SEQ ID NO: 1889 - protein, 10 aa, Artificial Sequence
  Description of Artificial Sequence: Synthetic peptide
GYTFTNYGMN

SEQ ID NO: 1890 - protein, 9 aa, Artificial Sequence
  Description of Artificial Sequence: Synthetic peptide
SGWTVVRMY

SEQ ID NO: 1891 - protein, 8 aa, Artificial Sequence
  Description of Artificial Sequence: Synthetic peptide
REAGDGEE

SEQ ID NO: 1892 - protein, 14 aa, Artificial Sequence
  Description of Artificial Sequence: Synthetic peptide
HLQREAGDGEEFRS

SEQ ID NO: 1893 - protein, 19 aa, Artificial Sequence
  Description of Artificial Sequence: Synthetic peptide
GAYPEYILDIHVYRVQLEL

SEQ ID NO: 1894 - protein, 22 aa, Artificial Sequence
  Description of Artificial Sequence: Synthetic peptide
SQEQLEHRYRSLITLYDIQLML

SEQ ID NO: 1895 - protein, 19 aa, Artificial Sequence
  Description of Artificial Sequence: Synthetic peptide
QELGDNDELMHFSYESTQD

SEQ ID NO: 1896 - protein, 16 aa, Artificial Sequence
  Description of Artificial Sequence: Synthetic peptide
YAYQRAIVEYMLRLMS

SEQ ID NO: 1897 - protein, 14 aa, Artificial Sequence
  Description of Artificial Sequence: Synthetic peptide
YEQAIAAYLDALMC

SEQ ID NO: 1898 - protein, 16 aa, Artificial Sequence
  Description of Artificial Sequence: Synthetic peptide
SCSEELEALEALELDE

SEQ ID NO: 1899 - protein, 31 aa, Artificial Sequence; identical to SEQ ID NO: 1327
  Description of Artificial Sequence: Synthetic polypeptide

SEQ ID NO: 1900 - protein, 20 aa, Artificial Sequence
  Description of Artificial Sequence: Synthetic peptide
RTLTVERLLEPLVTQVTTLV

SEQ ID NO: 1901 - protein, 57 aa, Artificial Sequence; identical to SEQ ID NO: 1329
  Description of Artificial Sequence: Synthetic polypeptide

SEQ ID NO: 1902 - protein, 9 aa, Artificial Sequence
  Description of Artificial Sequence: Synthetic peptide
  MOD_RES (2)..(3): Any amino acid
DXXEFDQYL

SEQ ID NO: 1903 - protein, 33 aa, Artificial Sequence; identical to SEQ ID NO: 1331
  Description of Artificial Sequence: Synthetic polypeptide

SEQ ID NO: 1904 - protein, 15 aa, Artificial Sequence
  Description of Artificial Sequence: Synthetic peptide
FEGIALTNYLKALEG

SEQ ID NO: 1905 - protein, 6 aa, Artificial Sequence
  Description of Artificial Sequence: Synthetic peptide
PLYISY

SEQ ID NO: 1906 - protein, 19 aa, Artificial Sequence
  Description of Artificial Sequence: Synthetic peptide
SIEDLHEYWARLWNYLYVA

SEQ ID NO: 1907 - protein, 20 aa, Artificial Sequence
  Description of Artificial Sequence: Synthetic peptide
QASLEELHEYWARLWNYRVA

SEQ ID NO: 1908 - protein, 22 aa, Artificial Sequence
  Description of Artificial Sequence: Synthetic peptide
NASIKQLHAYWQRLYAYLAAVA

SEQ ID NO: 1909 - protein, 12 aa, Artificial Sequence
  Description of Artificial Sequence: Synthetic peptide
CMWWREICPVWW

SEQ ID NO: 1910 - protein, 11 aa, Artificial Sequence
  Description of Artificial Sequence: Synthetic peptide
FARKTFLKLAF

SEQ ID NO: 1911 - protein, 10 aa, Artificial Sequence
  Description of Artificial Sequence: Synthetic peptide
ARRFFLDIAD

SEQ ID NO: 1912 - protein, 10 aa, Artificial Sequence
  Description of Artificial Sequence: Synthetic peptide
  MOD_RES (5)..(6): Any amino acid
  MOD_RES (9)..(10): Any amino acid
FRWPXXRLXX

SEQ ID NO: 1913 - protein, 8 aa, Artificial Sequence
  Description of Artificial Sequence: Synthetic peptide
  MOD_RES (1)..(1): A, C, D, E, G, H, K, N, Q, R, S, or T
  MOD_RES (2)..(2): A, C, D, E, F, G, H, I, K, L, M, N, P, Q, R, S, T, V, W, or Y
  MOD_RES (5)..(5): Any amino acid
  MOD_RES (6)..(6): A, C, F, G, H, I, K, L, M, R, T, V, W, or Y
  MOD_RES (7)..(7): A, C, D, E, F, G, H, I, K, L, M, N, P, Q, R, S, T, V, W, or Y
  MOD_RES (8)..(8): C, D, E, H, K, N, Q, R, S, or T
XXVFXXXX

SEQ ID NO: 1914 - protein, 9 aa, Artificial Sequence
  Description of Artificial Sequence: Synthetic peptide
YGHGQVYYY

SEQ ID NO: 1915 - protein, 6 aa, Artificial Sequence
  Description of Artificial Sequence: Synthetic peptide
ENPKQN

SEQ ID NO: 1916 - protein, 12 aa, Artificial Sequence
  Description of Artificial Sequence: Synthetic peptide
DAYECLDASRPW

SEQ ID NO: 1917 - protein, 7 aa, Artificial Sequence
  Description of Artificial Sequence: Synthetic peptide
KSRDFYH

SEQ ID NO: 1918 - protein, 16 aa, Artificial Sequence
  Description of Artificial Sequence: Synthetic peptide
AGVEHQLRREVEIQSH

SEQ ID NO: 1919 - protein, 25 aa, Artificial Sequence
  Description of Artificial Sequence: Synthetic peptide
WSVHAPSSRRTTLAGTLDYLPPEMI

SEQ ID NO: 1920 - protein, 6 aa, Artificial Sequence
  Description of Artificial Sequence: Synthetic peptide
TYQETY

SEQ ID NO: 1921 - protein, 32 aa, Artificial Sequence; identical to SEQ ID NO: 1349
  Description of Artificial Sequence: Synthetic polypeptide

SEQ ID NO: 1922 - protein, 14 aa, Artificial Sequence
  Description of Artificial Sequence: Synthetic peptide
NELKRSFAALRDQI

SEQ ID NO: 1923 - protein, 14 aa, Artificial Sequence
  Description of Artificial Sequence: Synthetic peptide
NELKRAFAALRDQI

SEQ ID NO: 1924 - protein, 29 aa, Artificial Sequence
  Description of Artificial Sequence: Synthetic peptide
IREKNHYHRQEVDDLRRQNALLEQQVRAL

SEQ ID NO: 1925 - protein, 11 aa, Artificial Sequence
  Description of Artificial Sequence: Synthetic peptide
FNHITNASQWE

SEQ ID NO: 1926 - protein, 11 aa, Artificial Sequence
  Description of Artificial Sequence: Synthetic peptide
GDLGAFSRGQM

SEQ ID NO: 1927 - protein, 17 aa, Artificial Sequence
  Description of Artificial Sequence: Synthetic peptide
RSEFYYYGNTYYYSAMD

SEQ ID NO: 1928 - protein, 9 aa, Artificial Sequence
  Description of Artificial Sequence: Synthetic peptide
QHDYTATDE

SEQ ID NO: 1929 - protein, 10 aa, Artificial Sequence
  Description of Artificial Sequence: Synthetic peptide
QNPEEQDEGW

SEQ ID NO: 1930 - protein, 11 aa, Artificial Sequence
  Description of Artificial Sequence: Synthetic peptide
EKCRGVFPENF

SEQ ID NO: 1931 - protein, 13 aa, Artificial Sequence
  Description of Artificial Sequence: Synthetic peptide
KWTLERLKRKYRN

SEQ ID NO: 1932 - protein, 17 aa, Artificial Sequence
  Description of Artificial Sequence: Synthetic peptide
TWRVQRSQNPLKIRLTR

SEQ ID NO: 1933 - protein, 12 aa, Artificial Sequence
  Description of Artificial Sequence: Synthetic peptide
TMRGKKKRTRAN

SEQ ID NO: 1934 - protein, 15 aa, Artificial Sequence
  Description of Artificial Sequence: Synthetic peptide
SYSYDAPSDFINFSS

SEQ ID NO: 1935 - protein, 37 aa, Artificial Sequence; identical to SEQ ID NO: 1401
  Description of Artificial Sequence: Synthetic polypeptide

SEQ ID NO: 1936 - protein, 24 aa, Artificial Sequence
  Description of Artificial Sequence: Synthetic peptide
MSQVKSSYSYDAPSDFINFSSLDD

SEQ ID NO: 1937 - protein, 31 aa, Artificial Sequence; identical to SEQ ID NO: 1403
  Description of Artificial Sequence: Synthetic polypeptide

SEQ ID NO: 1938 - protein, 29 aa, Artificial Sequence
  Description of Artificial Sequence: Synthetic peptide
LEFDSLQPCFYPDEDDFYFGGPDSTPPGE

SEQ ID NO: 1939 - protein, 15 aa, Artificial Sequence
  Description of Artificial Sequence: Synthetic peptide
RLYGFKIHPMAYQLQ

SEQ ID NO: 1940 - protein, 19 aa, Artificial Sequence
  Description of Artificial Sequence: Synthetic peptide
EPPLNPHGSARAEVHLRKS

SEQ ID NO: 1941 - protein, 20 aa, Artificial Sequence
  Description of Artificial Sequence: Synthetic peptide
SAVMERLRRRIELCRRHHST

SEQ ID NO: 1942 - protein, 22 aa, Artificial Sequence
  Description of Artificial Sequence: Synthetic peptide
TYTKKQVLRMEHLVLKVLTFDL

SEQ ID NO: 1943 - protein, 20 aa, Artificial Sequence
  Description of Artificial Sequence: Synthetic peptide
LVCKSYRLDWEAGALFRSLF

SEQ ID NO: 1944 - protein, 20 aa, Artificial Sequence
  Description of Artificial Sequence: Synthetic peptide
YSFVHHGFFNFRVSWREMLA

SEQ ID NO: 1945 - protein, 5 aa, Artificial Sequence
  Description of Artificial Sequence: Synthetic peptide
TAALS

SEQ ID NO: 1946 - protein, 5 aa, Artificial Sequence
  Description of Artificial Sequence: Synthetic peptide
TALLS

SEQ ID NO: 1947 - protein, 5 aa, Artificial Sequence
  Description of Artificial Sequence: Synthetic peptide
LAALS

SEQ ID NO: 1948 - protein, 5 aa, Artificial Sequence
  Description of Artificial Sequence: Synthetic peptide
DAALT

SEQ ID NO: 1949 - protein, 5 aa, Artificial Sequence
  Description of Artificial Sequence: Synthetic peptide
YAALQ

SEQ ID NO: 1950 - protein, 11 aa, Artificial Sequence
  Description of Artificial Sequence: Synthetic peptide
  MOD_RES (4)..(4): Any amino acid
SKLXRFTGCSC

SEQ ID NO: 1951 - protein, 8 aa, Artificial Sequence
  Description of Artificial Sequence: Synthetic peptide
PVKRRLFL

SEQ ID NO: 1952 - protein, 26 aa, Artificial Sequence
  Description of Artificial Sequence: Synthetic peptide
GRKRRQTSMTDFYHSKRRLIFSKRKP

SEQ ID NO: 1953 - protein, 16 aa, Artificial Sequence
  Description of Artificial Sequence: Synthetic peptide
MAGPMQTSTPKNAGKK

SEQ ID NO: 1954 - protein, 9 aa, Artificial Sequence
  Description of Artificial Sequence: Synthetic peptide
FDPPLHSTA

SEQ ID NO: 1955 - protein, 7 aa, Artificial Sequence
  Description of Artificial Sequence: Synthetic peptide
PLHSTAI

SEQ ID NO: 1956 - protein, 6 aa, Artificial Sequence
  Description of Artificial Sequence: Synthetic peptide
MDSTPL

SEQ ID NO: 1957 - protein, 7 aa, Artificial Sequence
  Description of Artificial Sequence: Synthetic peptide
FSQHKTI

SEQ ID NO: 1958 - protein, 11 aa, Artificial Sequence
  Description of Artificial Sequence: Synthetic peptide
LHYPSTTALQE

SEQ ID NO: 1959 - protein, 9 aa, Artificial Sequence
  Description of Artificial Sequence: Synthetic peptide
LLCSTPNGL

SEQ ID NO: 1960 - protein, 12 aa, Artificial Sequence
  Description of Artificial Sequence: Synthetic peptide
EAIYAAPFAKKK

SEQ ID NO: 1961 - protein, 9 aa, Artificial Sequence
  Description of Artificial Sequence: Synthetic peptide
APSYPPPPP

SEQ ID NO: 1962 - protein, 8 aa, Artificial Sequence
  Description of Artificial Sequence: Synthetic peptide
LQTIQEEE

SEQ ID NO: 1963 - protein, 4 aa, Artificial Sequence
  Description of Artificial Sequence: Synthetic peptide
SILK

SEQ ID NO: 1964 - protein, 15 aa, Artificial Sequence
  Description of Artificial Sequence: Synthetic peptide
SRRVSFADTIKVFQT

SEQ ID NO: 1965 - protein, 27 aa, Artificial Sequence
  Description of Artificial Sequence: Synthetic peptide
FSSNRQKILERTEILNQEWKQRRIQPV

SEQ ID NO: 1966 - protein, 21 aa, Artificial Sequence
  Description of Artificial Sequence: Synthetic peptide
KALETLRRVGDGVQRNHETAF

SEQ ID NO: 1967 - protein, 25 aa, Artificial Sequence
  Description of Artificial Sequence: Synthetic peptide
AELEVESATQLRRFGDKLNFRQKLL

SEQ ID NO: 1968 - protein, 21 aa, Artificial Sequence
  Description of Artificial Sequence: Synthetic peptide
  MOD_RES (8)..(8): Any amino acid
  MOD_RES (12)..(12): Any amino acid
KALETLRXVGDXVQRNHETAF

SEQ ID NO: 1969 - protein, 11 aa, Artificial Sequence
  Description of Artificial Sequence: Synthetic peptide
KEAPPAPPQDP

SEQ ID NO: 1970 - protein, 8 aa, Artificial Sequence
  Description of Artificial Sequence: Synthetic peptide
LSRRPDYR

SEQ ID NO: 1971 - protein, 14 aa, Artificial Sequence
  Description of Artificial Sequence: Synthetic peptide
RREGGMSRPADVDG

SEQ ID NO: 1972 - protein, 26 aa, Artificial Sequence
  Description of Artificial Sequence: Synthetic peptide
YRRAAVPPSPSLSRHSSPSQDEDEEE

SEQ ID NO: 1973 - protein, 9 aa, Artificial Sequence
  Description of Artificial Sequence: Synthetic peptide
SGWTVVRMY

SEQ ID NO: 1974 - protein, 8 aa, Artificial Sequence
  Description of Artificial Sequence: Synthetic peptide
REAGDGEE

SEQ ID NO: 1975 - protein, 14 aa, Artificial Sequence
  Description of Artificial Sequence: Synthetic peptide
HLQREAGDGEEFRS

SEQ ID NO: 1976 - protein, 21 aa, Artificial Sequence
  Description of Artificial Sequence: Synthetic peptide
IWIAQELRRIGDEFNAYYARR

SEQ ID NO: 1977 - protein, 16 aa, Artificial Sequence
  Description of Artificial Sequence: Synthetic peptide
GQVGRQLAIIGDDINR

SEQ ID NO: 1978 - protein, 25 aa, Artificial Sequence
  Description of Artificial Sequence: Synthetic peptide
NLWAAQRYGRELRRMSDEFVDSFKK

SEQ ID NO: 1979 - protein, 42 aa, Artificial Sequence; identical to SEQ ID NO: 1445
  Description of Artificial Sequence: Synthetic polypeptide

SEQ ID NO: 1980 - protein, 32 aa, Artificial Sequence; identical to SEQ ID NO: 1446
  Description of Artificial Sequence: Synthetic polypeptide

SEQ ID NO: 1981 - protein, 15 aa, Artificial Sequence
  Description of Artificial Sequence: Synthetic peptide
ATQLRRFGDKLNFRQ

SEQ ID NO: 1982 - protein, 20 aa, Artificial Sequence
  Description of Artificial Sequence: Synthetic peptide
EIVAKYIHYKLSQRGYEWDA

SEQ ID NO: 1983 - protein, 14 aa, Artificial Sequence
  Description of Artificial Sequence: Synthetic peptide
KKRYDREFLLGFQF

SEQ ID NO: 1984 - protein, 34 aa, Artificial Sequence; identical to SEQ ID NO: 1450
  Description of Artificial Sequence: Synthetic polypeptide

SEQ ID NO: 1985 - protein, 34 aa, Artificial Sequence; identical to SEQ ID NO: 1451
  Description of Artificial Sequence: Synthetic polypeptide

SEQ ID NO: 1986 - protein, 36 aa, Artificial Sequence; identical to SEQ ID NO: 1452
  Description of Artificial Sequence: Synthetic polypeptide

SEQ ID NO: 1987 - protein, 36 aa, Artificial Sequence; identical to SEQ ID NO: 1453
  Description of Artificial Sequence: Synthetic polypeptide

SEQ ID NO: 1988 - protein, 15 aa, Artificial Sequence
  Description of Artificial Sequence: Synthetic peptide
HIRGSITQGIPRSYV

SEQ ID NO: 1989 - protein, 9 aa, Artificial Sequence
  Description of Artificial Sequence: Synthetic peptide
GRSIHEIPR

SEQ ID NO: 1990 - protein, 21 aa, Artificial Sequence
  Description of Artificial Sequence: Synthetic peptide
GLVATVKEAGRSIHEIPREEL

SEQ ID NO: 1991 - protein, 12 aa, Artificial Sequence
  Description of Artificial Sequence: Synthetic peptide
KDYEEVGVDSVE

SEQ ID NO: 1992 - protein, 13 aa, Artificial Sequence
  Description of Artificial Sequence: Synthetic peptide
YQQYQDATADEQG

SEQ ID NO: 1993 - protein, 20 aa, Artificial Sequence
  Description of Artificial Sequence: Synthetic peptide
DAVRRIEDMMNQARHASSGV

SEQ ID NO: 1994 - protein, 13 aa, Artificial Sequence
  Description of Artificial Sequence: Synthetic peptide
YVYNTRSGWRWYT

SEQ ID NO: 1995 - protein, 17 aa, Artificial Sequence
  Description of Artificial Sequence: Synthetic peptide
VRKRTLRRLLQERELVE

SEQ ID NO: 1996 - protein, 28 aa, Artificial Sequence
  Description of Artificial Sequence: Synthetic peptide
RQVRELENYIDRLVRVMEETPNILRIPR

SEQ ID NO: 1997 - protein, 7 aa, Artificial Sequence
  Description of Artificial Sequence: Synthetic peptide
KKSRALF

SEQ ID NO: 1998 - protein, 12 aa, Artificial Sequence
  Description of Artificial Sequence: Synthetic peptide
RCLSSSAVANRS

SEQ ID NO: 1999 - protein, 12 aa, Artificial Sequence
  Description of Artificial Sequence: Synthetic peptide
RSLSSSAVANRS

SEQ ID NO: 2000 - protein, 13 aa, Artificial Sequence
  Description of Artificial Sequence: Synthetic peptide
AVANRSKKSRALF

SEQ ID NO: 2001 - protein, 19 aa, Artificial Sequence
  Description of Artificial Sequence: Synthetic peptide
RCESSSAEANRSKKERELF

SEQ ID NO: 2002 - protein, 13 aa, Artificial Sequence
  Description of Artificial Sequence: Synthetic peptide
ASSESQRYVYSIL

SEQ ID NO: 2003 - protein, 13 aa, Artificial Sequence
  Description of Artificial Sequence: Synthetic peptide
ASSASQEYVYSIL

SEQ ID NO: 2004 - protein, 18 aa, Artificial Sequence
  Description of Artificial Sequence: Synthetic peptide
RSSAMDENSEKKRKSAIK

SEQ ID NO: 2005 - protein, 14 aa, Artificial Sequence
  Description of Artificial Sequence: Synthetic peptide
GDENSEKKRKQAIK

SEQ ID NO: 2006 - protein, 10 aa, Artificial Sequence
  Description of Artificial Sequence: Synthetic peptide
SGRRYGHALR

SEQ ID NO: 2007 - protein, 10 aa, Artificial Sequence
  Description of Artificial Sequence: Synthetic peptide
ATGAPRLPST

SEQ ID NO: 2008 - protein, 10 aa, Artificial Sequence
  Description of Artificial Sequence: Synthetic peptide
RLAHGYRRGS

SEQ ID NO: 2009 - protein, 13 aa, Artificial Sequence
  Description of Artificial Sequence: Synthetic peptide
RTLFKAHMGQKHR

SEQ ID NO: 2010 - protein, 10 aa, Artificial Sequence
  Description of Artificial Sequence: Synthetic peptide
YSRVGRSVTD

SEQ ID NO: 2011 - protein, 12 aa, Artificial Sequence
  Description of Artificial Sequence: Synthetic peptide
HSKGHQKRKALK

SEQ ID NO: 2012 - protein, 12 aa, Artificial Sequence
  Description of Artificial Sequence: Synthetic peptide
MGYQKKLRSMTD

SEQ ID NO: 2013 - protein, 16 aa, Artificial Sequence
  Description of Artificial Sequence: Synthetic peptide
MGYQKKLRSMTDKYRL

SEQ ID NO: 2014 - protein, 10 aa, Artificial Sequence
  Description of Artificial Sequence: Synthetic peptide
GMRPYDANKR

SEQ ID NO: 2015 - protein, 7 aa, Artificial Sequence
  Description of Artificial Sequence: Synthetic peptide
GRPYDAN

SEQ ID NO: 2016 - protein, 16 aa, Artificial Sequence
  Description of Artificial Sequence: Synthetic peptide
KIHKKGMIKSSRPLRV

SEQ ID NO: 2017 - protein, 10 aa, Artificial Sequence
  Description of Artificial Sequence: Synthetic peptide
KIHKKGMIKS

SEQ ID NO: 2018 - protein, 12 aa, Artificial Sequence
  Description of Artificial Sequence: Synthetic peptide
KIHKKGMIKSSR

SEQ ID NO: 2019 - protein, 16 aa, Artificial Sequence
  Description of Artificial Sequence: Synthetic peptide
KRKALKALILNEKKVQ

SEQ ID NO: 2020 - protein, 12 aa, Artificial Sequence
  Description of Artificial Sequence: Synthetic peptide
TFVADWRNSNRY

SEQ ID NO: 2021 - protein, 23 aa, Artificial Sequence
  Description of Artificial Sequence: Synthetic peptide
TWAWHTSFKALGTTYQPLSGKTS

SEQ ID NO: 2022 - protein, 31 aa, Artificial Sequence; identical to SEQ ID NO: 1488
  Description of Artificial Sequence: Synthetic polypeptide

SEQ ID NO: 2023 - protein, 12 aa, Artificial Sequence
  Description of Artificial Sequence: Synthetic peptide
RNNSRLGNGVLY

SEQ ID NO: 2024 - protein, 10 aa, Artificial Sequence
  Description of Artificial Sequence: Synthetic peptide
RRERRDLFTE

SEQ ID NO: 2025 - protein, 12 aa, Artificial Sequence
  Description of Artificial Sequence: Synthetic peptide
MGETVNKIAQES

SEQ ID NO: 2026 - protein, 11 aa, Artificial Sequence
  Description of Artificial Sequence: Synthetic peptide
RASQYFSSYLA

SEQ ID NO: 2027 - protein, 16 aa, Artificial Sequence
  Description of Artificial Sequence: Synthetic peptide
AREDFRNRRLWYVMDY

SEQ ID NO: 2028 - protein, 13 aa, Artificial Sequence
  Description of Artificial Sequence: Synthetic peptide
KASGYSFTDYFIY

SEQ ID NO: 2029 - protein, 8 aa, Artificial Sequence
  Description of Artificial Sequence: Synthetic peptide
YRDRRRPS

SEQ ID NO: 2030 - protein, 13 aa, Artificial Sequence
  Description of Artificial Sequence: Synthetic peptide
SGSSSDIGSNYVS

SEQ ID NO: 2031 - protein, 9 aa, Artificial Sequence
  Description of Artificial Sequence: Synthetic peptide
QQWSSHIFT

SEQ ID NO: 2032 - protein, 14 aa, Artificial Sequence
  Description of Artificial Sequence: Synthetic peptide
ASRDYDYAGRYFDY

SEQ ID NO: 2033 - protein, 9 aa, Artificial Sequence
  Description of Artificial Sequence: Synthetic peptide
QNGHSFPFT

SEQ ID NO: 2034 - protein, 10 aa, Artificial Sequence
  Description of Artificial Sequence: Synthetic peptide
YINPYNDGTK

SEQ ID NO: 2035 - protein, 8 aa, Artificial Sequence
  Description of Artificial Sequence: Synthetic peptide
ARNWDVAY

SEQ ID NO: 2036 - protein, 11 aa, Artificial Sequence
  Description of Artificial Sequence: Synthetic peptide
SGYSFTGHWMN

SEQ ID NO: 2037 - protein, 10 aa, Artificial Sequence
  Description of Artificial Sequence: Synthetic peptide
MIHPSDSETR

SEQ ID NO: 2038 - protein, 14 aa, Artificial Sequence
  Description of Artificial Sequence: Synthetic peptide
ARGIYFYGTTYFDY

SEQ ID NO: 2039 - protein, 10 aa, Artificial Sequence
  Description of Artificial Sequence: Synthetic peptide
SGFSFTSSVS

SEQ ID NO: 2040 - protein, 9 aa, Artificial Sequence
  Description of Artificial Sequence: Synthetic peptide
LIYPYNGFN

SEQ ID NO: 2041 - protein, 13 aa, Artificial Sequence
  Description of Artificial Sequence: Synthetic peptide
AASGFTFTSTGIS

SEQ ID NO: 2042 - protein, 15 aa, Artificial Sequence
  Description of Artificial Sequence: Synthetic peptide
ARTYGIYDLYVDYTE

SEQ ID NO: 2043 - protein, 9 aa, Artificial Sequence
  Description of Artificial Sequence: Synthetic peptide
SRDYGYYFD

SEQ ID NO: 2044 - protein, 10 aa, Artificial Sequence
  Description of Artificial Sequence: Synthetic peptide
GYSFTRYWMH

SEQ ID NO: 2045 - protein, 8 aa, Artificial Sequence
  Description of Artificial Sequence: Synthetic peptide
QWWWWPST

SEQ ID NO: 2046 - protein, 12 aa, Artificial Sequence
  Description of Artificial Sequence: Synthetic peptide
ASGFSIWWSWIH

SEQ ID NO: 2047 - protein, 8 aa, Artificial Sequence
  Description of Artificial Sequence: Synthetic peptide
YDNNQRPS

SEQ ID NO: 2048 - protein, 17 aa, Artificial Sequence
  Description of Artificial Sequence: Synthetic peptide
TFHIRRYRSGYYDKMDH

SEQ ID NO: 2049 - protein, 12 aa, Artificial Sequence
  Description of Artificial Sequence: Synthetic peptide
ARGPFSPWVMDY

SEQ ID NO: 2050 - protein, 9 aa, Artificial Sequence
  Description of Artificial Sequence: Synthetic peptide
TRHDGTNFD

SEQ ID NO: 2051 - protein, 9 aa, Artificial Sequence
  Description of Artificial Sequence: Synthetic peptide
QQAKAFPPT

SEQ ID NO: 2052 - protein, 12 aa, Artificial Sequence
  Description of Artificial Sequence: Synthetic peptide
SGHVNAVKNYGY

SEQ ID NO: 2053 - protein, 8 aa, Artificial Sequence
  Description of Artificial Sequence: Synthetic peptide
WINTETGS

SEQ ID NO: 2054 - protein, 8 aa, Artificial Sequence
  Description of Artificial Sequence: Synthetic peptide
WINTYTGE

SEQ ID NO: 2055 - protein, 10 aa, Artificial Sequence
  Description of Artificial Sequence: Synthetic peptide
GYTFTNYGMN

SEQ ID NO: 2056 - protein, 21 aa, Artificial Sequence
  Description of Artificial Sequence: Synthetic peptide
IWIAQELRRIGDEFNAYYARR

SEQ ID NO: 2057 - protein, 16 aa, Artificial Sequence
  Description of Artificial Sequence: Synthetic peptide
GQVGRQLAIIGDDINR

SEQ ID NO: 2058 - protein, 25 aa, Artificial Sequence
  Description of Artificial Sequence: Synthetic peptide
NLWAAQRYGRELRRMSDEFVDSFKK

SEQ ID NO: 2059 - protein, 42 aa, Artificial Sequence; identical to SEQ ID NO: 1445
  Description of Artificial Sequence: Synthetic polypeptide

SEQ ID NO: 2060 - protein, 32 aa, Artificial Sequence; identical to SEQ ID NO: 1446
  Description of Artificial Sequence: Synthetic polypeptide

SEQ ID NO: 2061 - protein, 15 aa, Artificial Sequence
  Description of Artificial Sequence: Synthetic peptide
ATQLRRFGDKLNFRQ

SEQ ID NO: 2062 - protein, 20 aa, Artificial Sequence
  Description of Artificial Sequence: Synthetic peptide
EIVAKYIHYKLSQRGYEWDA

SEQ ID NO: 2063 - protein, 14 aa, Artificial Sequence
  Description of Artificial Sequence: Synthetic peptide
KKRYDREFLLGFQF

SEQ ID NO: 2064 - protein, 34 aa, Artificial Sequence; identical to SEQ ID NO: 1450
  Description of Artificial Sequence: Synthetic polypeptide

SEQ ID NO: 2065 - protein, 34 aa, Artificial Sequence; identical to SEQ ID NO: 1451
  Description of Artificial Sequence: Synthetic polypeptide

SEQ ID NO: 2066 - protein, 36 aa, Artificial Sequence; identical to SEQ ID NO: 1452
  Description of Artificial Sequence: Synthetic polypeptide

SEQ ID NO: 2067 - protein, 36 aa, Artificial Sequence; identical to SEQ ID NO: 1453
  Description of Artificial Sequence: Synthetic polypeptide

SEQ ID NO: 2068 - protein, 15 aa, Artificial Sequence
  Description of Artificial Sequence: Synthetic peptide
HIRGSITQGIPRSYV

SEQ ID NO: 2069 - protein, 9 aa, Artificial Sequence
  Description of Artificial Sequence: Synthetic peptide
GRSIHEIPR

SEQ ID NO: 2070 - protein, 21 aa, Artificial Sequence
  Description of Artificial Sequence: Synthetic peptide
GLVATVKEAGRSIHEIPREEL

SEQ ID NO: 2071 - protein, 12 aa, Artificial Sequence
  Description of Artificial Sequence: Synthetic peptide
KDYEEVGVDSVE

SEQ ID NO: 2072 - protein, 13 aa, Artificial Sequence
  Description of Artificial Sequence: Synthetic peptide
YQQYQDATADEQG

SEQ ID NO: 2073 - protein, 20 aa, Artificial Sequence
  Description of Artificial Sequence: Synthetic peptide
DAVRRIEDMMNQARHASSGV

SEQ ID NO: 2074 - protein, 13 aa, Artificial Sequence
  Description of Artificial Sequence: Synthetic peptide
YVYNTRSGWRWYT

SEQ ID NO: 2075 - protein, 17 aa, Artificial Sequence
  Description of Artificial Sequence: Synthetic peptide
VRKRTLRRLLQERELVE

SEQ ID NO: 2076 - protein, 28 aa, Artificial Sequence
  Description of Artificial Sequence: Synthetic peptide
RQVRELENYIDRLVRVMEETPNILRIPR

SEQ ID NO: 2077 - protein, 7 aa, Artificial Sequence
  Description of Artificial Sequence: Synthetic peptide
KKSRALF

SEQ ID NO: 2078 - protein, 12 aa, Artificial Sequence
  Description of Artificial Sequence: Synthetic peptide
RCLSSSAVANRS

SEQ ID NO: 2079 - protein, 12 aa, Artificial Sequence
  Description of Artificial Sequence: Synthetic peptide
RSLSSSAVANRS

SEQ ID NO: 2080 - protein, 13 aa, Artificial Sequence
  Description of Artificial Sequence: Synthetic peptide
AVANRSKKSRALF

SEQ ID NO: 2081 - protein, 19 aa, Artificial Sequence
  Description of Artificial Sequence: Synthetic peptide
RCESSSAEANRSKKERELF

SEQ ID NO: 2082 - protein, 13 aa, Artificial Sequence
  Description of Artificial Sequence: Synthetic peptide
ASSESQRYVYSIL

SEQ ID NO: 2083 - protein, 13 aa, Artificial Sequence
  Description of Artificial Sequence: Synthetic peptide
ASSASQEYVYSIL

SEQ ID NO: 2084 - protein, 18 aa, Artificial Sequence
  Description of Artificial Sequence: Synthetic peptide
RSSAMDENSEKKRKSAIK

SEQ ID NO: 2085 - protein, 14 aa, Artificial Sequence
  Description of Artificial Sequence: Synthetic peptide
GDENSEKKRKQAIK

SEQ ID NO: 2086 - protein, 10 aa, Artificial Sequence
  Description of Artificial Sequence: Synthetic peptide
SGRRYGHALR

SEQ ID NO: 2087 - protein, 10 aa, Artificial Sequence
  Description of Artificial Sequence: Synthetic peptide
ATGAPRLPST

SEQ ID NO: 2088 - protein, 10 aa, Artificial Sequence
  Description of Artificial Sequence: Synthetic peptide
RLAHGYRRGS

SEQ ID NO: 2089 - protein, 13 aa, Artificial Sequence
  Description of Artificial Sequence: Synthetic peptide
RTLFKAHMGQKHR

SEQ ID NO: 2090 - protein, 10 aa, Artificial Sequence
  Description of Artificial Sequence: Synthetic peptide
YSRVGRSVTD

SEQ ID NO: 2091 - protein, 12 aa, Artificial Sequence
  Description of Artificial Sequence: Synthetic peptide
HSKGHQKRKALK

SEQ ID NO: 2092 - protein, 12 aa, Artificial Sequence
  Description of Artificial Sequence: Synthetic peptide
MGYQKKLRSMTD

SEQ ID NO: 2093 - protein, 16 aa, Artificial Sequence
  Description of Artificial Sequence: Synthetic peptide
MGYQKKLRSMTDKYRL

SEQ ID NO: 2094 - protein, 10 aa, Artificial Sequence
  Description of Artificial Sequence: Synthetic peptide
GMRPYDANKR

SEQ ID NO: 2095 - protein, 7 aa, Artificial Sequence
  Description of Artificial Sequence: Synthetic peptide
GRPYDAN

SEQ ID NO: 2096 - protein, 16 aa, Artificial Sequence
  Description of Artificial Sequence: Synthetic peptide
KIHKKGMIKSSRPLRV

SEQ ID NO: 2097 - protein, 10 aa, Artificial Sequence
  Description of Artificial Sequence: Synthetic peptide
KIHKKGMIKS

SEQ ID NO: 2098 - protein, 12 aa, Artificial Sequence
  Description of Artificial Sequence: Synthetic peptide
KIHKKGMIKSSR

SEQ ID NO: 2099 - protein, 16 aa, Artificial Sequence
  Description of Artificial Sequence: Synthetic peptide
KRKALKALILNEKKVQ

SEQ ID NO: 2100 - protein, 12 aa, Artificial Sequence
  Description of Artificial Sequence: Synthetic peptide
TFVADWRNSNRY

SEQ ID NO: 2101 - protein, 23 aa, Artificial Sequence
  Description of Artificial Sequence: Synthetic peptide
TWAWHTSFKALGTTYQPLSGKTS

SEQ ID NO: 2102 - protein, 31 aa, Artificial Sequence; identical to SEQ ID NO: 1488
  Description of Artificial Sequence: Synthetic polypeptide

SEQ ID NO: 2103 - protein, 12 aa, Artificial Sequence
  Description of Artificial Sequence: Synthetic peptide
RNNSRLGNGVLY

SEQ ID NO: 2104 - protein, 10 aa, Artificial Sequence
  Description of Artificial Sequence: Synthetic peptide
RRERRDLFTE

SEQ ID NO: 2105 - protein, 12 aa, Artificial Sequence
  Description of Artificial Sequence: Synthetic peptide
MGETVNKIAQES

SEQ ID NO: 2106 - protein, 11 aa, Artificial Sequence
  Description of Artificial Sequence: Synthetic peptide
RASQYFSSYLA

SEQ ID NO: 2107 - protein, 16 aa, Artificial Sequence
  Description of Artificial Sequence: Synthetic peptide
AREDFRNRRLWYVMDY

SEQ ID NO: 2108 - protein, 13 aa, Artificial Sequence
  Description of Artificial Sequence: Synthetic peptide
KASGYSFTDYFIY

SEQ ID NO: 2109 - protein, 8 aa, Artificial Sequence
  Description of Artificial Sequence: Synthetic peptide
YRDRRRPS

SEQ ID NO: 2110 - protein, 13 aa, Artificial Sequence
  Description of Artificial Sequence: Synthetic peptide
SGSSSDIGSNYVS

SEQ ID NO: 2111 - protein, 9 aa, Artificial Sequence
  Description of Artificial Sequence: Synthetic peptide
QQWSSHIFT

SEQ ID NO: 2112 - protein, 14 aa, Artificial Sequence
  Description of Artificial Sequence: Synthetic peptide
ASRDYDYAGRYFDY

SEQ ID NO: 2113 - protein, 9 aa, Artificial Sequence
  Description of Artificial Sequence: Synthetic peptide
QNGHSFPFT

SEQ ID NO: 2114 - protein, 10 aa, Artificial Sequence
  Description of Artificial Sequence: Synthetic peptide
YINPYNDGTK

SEQ ID NO: 2115 - protein, 8 aa, Artificial Sequence
  Description of Artificial Sequence: Synthetic peptide
ARNWDVAY

SEQ ID NO: 2116 - protein, 11 aa, Artificial Sequence
  Description of Artificial Sequence: Synthetic peptide
SGYSFTGHWMN

SEQ ID NO: 2117 - protein, 10 aa, Artificial Sequence
  Description of Artificial Sequence: Synthetic peptide
MIHPSDSETR

SEQ ID NO: 2118 - protein, 14 aa, Artificial Sequence
  Description of Artificial Sequence: Synthetic peptide
ARGIYFYGTTYFDY

SEQ ID NO: 2119 - protein, 10 aa, Artificial Sequence
  Description of Artificial Sequence: Synthetic peptide
SGFSFTSSVS

SEQ ID NO: 2120 - protein, 9 aa, Artificial Sequence
  Description of Artificial Sequence: Synthetic peptide
LIYPYNGFN

SEQ ID NO: 2121 - protein, 13 aa, Artificial Sequence
  Description of Artificial Sequence: Synthetic peptide
AASGFTFTSTGIS

SEQ ID NO: 2122 - protein, 15 aa, Artificial Sequence
  Description of Artificial Sequence: Synthetic peptide
ARTYGIYDLYVDYTE

SEQ ID NO: 2123 - protein, 9 aa, Artificial Sequence
  Description of Artificial Sequence: Synthetic peptide
SRDYGYYFD

SEQ ID NO: 2124 - protein, 10 aa, Artificial Sequence
  Description of Artificial Sequence: Synthetic peptide
GYSFTRYWMH

SEQ ID NO: 2125 - protein, 8 aa, Artificial Sequence
  Description of Artificial Sequence: Synthetic peptide
QWWWWPST

SEQ ID NO: 2126 - protein, 12 aa, Artificial Sequence
  Description of Artificial Sequence: Synthetic peptide
ASGFSIWWSWIH

SEQ ID NO: 2127 - protein, 8 aa, Artificial Sequence
  Description of Artificial Sequence: Synthetic peptide
YDNNQRPS

SEQ ID NO: 2128 - protein, 17 aa, Artificial Sequence
  Description of Artificial Sequence: Synthetic peptide
TFHIRRYRSGYYDKMDH

SEQ ID NO: 2129 - protein, 12 aa, Artificial Sequence
  Description of Artificial Sequence: Synthetic peptide
ARGPFSPWVMDY

SEQ ID NO: 2130 - protein, 9 aa, Artificial Sequence
  Description of Artificial Sequence: Synthetic peptide
TRHDGTNFD

SEQ ID NO: 2131 - protein, 9 aa, Artificial Sequence
  Description of Artificial Sequence: Synthetic peptide
QQAKAFPPT

SEQ ID NO: 2132 - protein, 12 aa, Artificial Sequence
  Description of Artificial Sequence: Synthetic peptide
SGHVNAVKNYGY

SEQ ID NO: 2133 - protein, 8 aa, Artificial Sequence
  Description of Artificial Sequence: Synthetic peptide
WINTETGS

SEQ ID NO: 2134 - protein, 8 aa, Artificial Sequence
  Description of Artificial Sequence: Synthetic peptide
WINTYTGE

SEQ ID NO: 2135 - protein, 10 aa, Artificial Sequence
  Description of Artificial Sequence: Synthetic peptide
GYTFTNYGMN

SEQ ID NO: 2136 - DNA, 93 bp, Artificial Sequence
  Description of Artificial Sequence: Synthetic oligonucleotide
cgcagcaaaaaagcgcatgtgctggcggcgagcgtggaacaggcgacccagaactttctggaaaaaggcgaacagattgcgaaagaaagccag

SEQ ID NO: 2137 - DNA, 60 bp, Artificial Sequence
  Description of Artificial Sequence: Synthetic oligonucleotide
cgcaccctgaccgtggaacgcctgctggaaccgctggtgacccaggtgaccaccctggtg

SEQ ID NO: 2138 - DNA, 171 bp, Artificial Sequence
  Description of Artificial Sequence: Synthetic polynucleotide
cgccgcgaacagctggaagcgcaggaagcgcgcgcgcgcgaagcgcatgcgcgcgaagcgcatgcgcgcgaagcgtatacccgcgaagcgtatggccgcgaagcgtatgcgcgcgaagcgcatacctgggaagcgcatggccgcgaagcgcgcacccgcgaagcgcaggcg

SEQ ID NO: 2139 - DNA, 27 bp, Artificial Sequence
  Description of Artificial Sequence: Synthetic oligonucleotide
  modified_base (4)..(9): n is a, c, g, or t
gatnnnnnngaatttgatcagtatctg

SEQ ID NO: 2140 - DNA, 99 bp, Artificial Sequence
  Description of Artificial Sequence: Synthetic oligonucleotide
caggcgctgctggataaagcgaaaattaaccagggctggctggatagcagccgcagcctgatggaacaggataaagaaaacgaagcgctgctgcgcttt

SEQ ID NO: 2141 - DNA, 45 bp, Artificial Sequence; identical to SEQ ID NO: 77
  Description of Artificial Sequence: Synthetic oligonucleotide

SEQ ID NO: 2142 - DNA, 18 bp, Artificial Sequence
  Description of Artificial Sequence: Synthetic oligonucleotide
cccctgtacatcagctac

SEQ ID NO: 2143 - DNA, 57 bp, Artificial Sequence
  Description of Artificial Sequence: Synthetic oligonucleotide
agcattgaagatctgcatgaatattgggcgcgcctgtggaactatctgtatgtggcg

SEQ ID NO: 2144 - DNA, 60 bp, Artificial Sequence
  Description of Artificial Sequence: Synthetic oligonucleotide
caggcgagcctggaagaactgcatgaatattgggcgcgcctgtggaactatcgcgtggcg

SEQ ID NO: 2145 - DNA, 66 bp, Artificial Sequence
  Description of Artificial Sequence: Synthetic oligonucleotide
aacgcgagcattaaacagctgcatgcgtattggcagcgcctgtatgcgtatctggcggcggtggcg

SEQ ID NO: 2146 - DNA, 36 bp, Artificial Sequence
  Description of Artificial Sequence: Synthetic oligonucleotide
tgcatgtggtggcgcgaaatttgcccggtgtggtgg

SEQ ID NO: 2147 - DNA, 33 bp, Artificial Sequence
  Description of Artificial Sequence: Synthetic oligonucleotide
tttgcgcgcaaaacctttctgaaactggcgttt

SEQ ID NO: 2148 - DNA, 30 bp, Artificial Sequence
  Description of Artificial Sequence: Synthetic oligonucleotide
gcgcgccgcttctttctggatattgcggat

SEQ ID NO: 2149 - DNA, 30 bp, Artificial Sequence
  Description of Artificial Sequence: Synthetic oligonucleotide
  modified_base (13)..(18): n is a, c, g, or t
  modified_base (25)..(30): n is a, c, g, or t
tttcgctggccgnnnnnncgcctgnnnnnn

SEQ ID NO: 2150 - DNA, 24 bp, Artificial Sequence
  Description of Artificial Sequence: Synthetic oligonucleotide
agcattgtgtttggcgcgcatgat

SEQ ID NO: 2151 - DNA, 27 bp, Artificial Sequence
  Description of Artificial Sequence: Synthetic oligonucleotide
tatggccatggccaggtgtattattat

SEQ ID NO: 2152 - DNA, 18 bp, Artificial Sequence
  Description of Artificial Sequence: Synthetic oligonucleotide
gaaaacccgaaacagaac

SEQ ID NO: 2153 - DNA, 36 bp, Artificial Sequence
  Description of Artificial Sequence: Synthetic oligonucleotide
gatgcgtatgaatgcctggatgcgagccgcccgtgg

SEQ ID NO: 2154 - DNA, 21 bp, Artificial Sequence
  Description of Artificial Sequence: Synthetic oligonucleotide
aaatcccgcgatttctatcat

SEQ ID NO: 2155 - DNA, 48 bp, Artificial Sequence
  Description of Artificial Sequence: Synthetic oligonucleotide
gcgggcgtggaacatcagctgcgccgcgaagtggaaattcagagccat

SEQ ID NO: 2156 - DNA, 75 bp, Artificial Sequence
  Description of Artificial Sequence: Synthetic oligonucleotide
tggagcgtgcatgcgccgagcagccgccgcaccgaactggcgggcaccctggattatctgccgccggaaatgatt

SEQ ID NO: 2157 - DNA, 18 bp, Artificial Sequence
  Description of Artificial Sequence: Synthetic oligonucleotide
acctatcaggaaacctat

SEQ ID NO: 2158 - DNA, 96 bp, Artificial Sequence
  Description of Artificial Sequence: Synthetic oligonucleotide
caggcggaagaacagaaactgagcgaagaagatctgctgcgcaaacgccgcgaacagctgaaacataaactggaacagctgcgcaacagctgcgcg

SEQ ID NO: 2159 - DNA, 42 bp, Artificial Sequence
  Description of Artificial Sequence: Synthetic oligonucleotide
aacgaactgaaacgcagctttgcggcgctgcgcgatcagatt

SEQ ID NO: 2160 - DNA, 42 bp, Artificial Sequence
  Description of Artificial Sequence: Synthetic oligonucleotide
aacgaactgaaacgcgcgtttgcggcgctgcgcgatcagatt

SEQ ID NO: 2161 - DNA, 87 bp, Artificial Sequence
  Description of Artificial Sequence: Synthetic oligonucleotide
attcgcgaaaaaaaccattatcatcgccaggaagtggatgatctgcgccgccagaacgcgctgctggaacagcaggtgcgcgcgctg

SEQ ID NO: 2162 - DNA, 33 bp, Artificial Sequence
  Description of Artificial Sequence: Synthetic oligonucleotide
tttaaccatattaccaacgcgagccagtgggaa

SEQ ID NO: 2163 - DNA, 33 bp, Artificial Sequence
  Description of Artificial Sequence: Synthetic oligonucleotide
ggcgatctgggcgcgtttagccgcggccagatg

SEQ ID NO: 2164 - DNA, 51 bp, Artificial Sequence
  Description of Artificial Sequence: Synthetic oligonucleotide
cgcagcgaattttattattatggcaacacctattattatagcgcgatggat

SEQ ID NO: 2165 - DNA, 27 bp, Artificial Sequence
  Description of Artificial Sequence: Synthetic oligonucleotide
cagcatgattataccgcgaccgatgaa

SEQ ID NO: 2166 - DNA, 30 bp, Artificial Sequence
  Description of Artificial Sequence: Synthetic oligonucleotide
cagaacccggaagaacaggatgaaggctgg

SEQ ID NO: 2167 - DNA, 33 bp, Artificial Sequence
  Description of Artificial Sequence: Synthetic oligonucleotide
gaaaagtgccgcggcgtgtttccggaaaacttt

SEQ ID NO: 2168 - DNA, 57 bp, Artificial Sequence; identical to SEQ ID NO: 65
  Description of Artificial Sequence: Synthetic oligonucleotide

SEQ ID NO: 2169 - DNA, 66 bp, Artificial Sequence; identical to SEQ ID NO: 67
  Description of Artificial Sequence: Synthetic oligonucleotide

SEQ ID NO: 2170 - DNA, 57 bp, Artificial Sequence; identical to SEQ ID NO: 69
  Description of Artificial Sequence: Synthetic oligonucleotide

SEQ ID NO: 2171 - DNA, 48 bp, Artificial Sequence; identical to SEQ ID NO: 71
  Description of Artificial Sequence: Synthetic oligonucleotide

SEQ ID NO: 2172 - DNA, 42 bp, Artificial Sequence; identical to SEQ ID NO: 73
  Description of Artificial Sequence: Synthetic oligonucleotide

SEQ ID NO: 2173 - DNA, 48 bp, Artificial Sequence; identical to SEQ ID NO: 75
  Description of Artificial Sequence: Synthetic oligonucleotide

SEQ ID NO: 2174 - DNA, 93 bp, Artificial Sequence; identical to SEQ ID NO: 2136
  Description of Artificial Sequence: Synthetic oligonucleotide

SEQ ID NO: 2175 - DNA, 60 bp, Artificial Sequence; identical to SEQ ID NO: 2137
  Description of Artificial Sequence: Synthetic oligonucleotide

SEQ ID NO: 2176 - DNA, 171 bp, Artificial Sequence; identical to SEQ ID NO: 2138
  Description of Artificial Sequence: Synthetic polynucleotide

SEQ ID NO: 2177 - DNA, 27 bp, Artificial Sequence
  Description of Artificial Sequence: Synthetic oligonucleotide
  modified_base (4)..(9): n is a, c, g, or t
gatnnnnnngaatttgatcagtatctg

SEQ ID NO: 2178 - DNA, 99 bp, Artificial Sequence; identical to SEQ ID NO: 2140
  Description of Artificial Sequence: Synthetic oligonucleotide

SEQ ID NO: 2179 - DNA, 45 bp, Artificial Sequence; identical to SEQ ID NO: 77
  Description of Artificial Sequence: Synthetic oligonucleotide

SEQ ID NO: 2180 - DNA, 18 bp, Artificial Sequence
  Description of Artificial Sequence: Synthetic oligonucleotide
cccctgtacatcagctac

SEQ ID NO: 2181 - DNA, 57 bp, Artificial Sequence; identical to SEQ ID NO: 2143
  Description of Artificial Sequence: Synthetic oligonucleotide

SEQ ID NO: 2182 - DNA, 60 bp, Artificial Sequence; identical to SEQ ID NO: 2144
  Description of Artificial Sequence: Synthetic oligonucleotide

SEQ ID NO: 2183 - DNA, 66 bp, Artificial Sequence; identical to SEQ ID NO: 2145
  Description of Artificial Sequence: Synthetic oligonucleotide

SEQ ID NO: 2184 - DNA, 36 bp, Artificial Sequence; identical to SEQ ID NO: 2146
  Description of Artificial Sequence: Synthetic oligonucleotide

SEQ ID NO: 2185 - DNA, 33 bp, Artificial Sequence; identical to SEQ ID NO: 2147
  Description of Artificial Sequence: Synthetic oligonucleotide

SEQ ID NO: 2186 - DNA, 30 bp, Artificial Sequence; identical to SEQ ID NO: 2148
  Description of Artificial Sequence: Synthetic oligonucleotide

SEQ ID NO: 2187 - DNA, 30 bp, Artificial Sequence; identical to SEQ ID NO: 2149
  Description of Artificial Sequence: Synthetic oligonucleotide
  modified_base (13)..(18): n is a, c, g, or t
  modified_base (25)..(30): n is a, c, g, or t

SEQ ID NO: 2188 - DNA, 24 bp, Artificial Sequence
  Description of Artificial Sequence: Synthetic oligonucleotide
agcattgtgtttggcgcgcatgat

SEQ ID NO: 2189 - DNA, 27 bp, Artificial Sequence
  Description of Artificial Sequence: Synthetic oligonucleotide
tatggccatggccaggtgtattattat

SEQ ID NO: 2190 - DNA, 18 bp, Artificial Sequence
  Description of Artificial Sequence: Synthetic oligonucleotide
gaaaacccgaaacagaac

SEQ ID NO: 2191 - DNA, 36 bp, Artificial Sequence; identical to SEQ ID NO: 2153
  Description of Artificial Sequence: Synthetic oligonucleotide

SEQ ID NO: 2192 - DNA, 21 bp, Artificial Sequence
  Description of Artificial Sequence: Synthetic oligonucleotide
aaatcccgcgatttctatcat

SEQ ID NO: 2193 - DNA, 48 bp, Artificial Sequence; identical to SEQ ID NO: 2155
  Description of Artificial Sequence: Synthetic oligonucleotide

SEQ ID NO: 2194 - DNA, 75 bp, Artificial Sequence; identical to SEQ ID NO: 2156
  Description of Artificial Sequence: Synthetic oligonucleotide

SEQ ID NO: 2195 - DNA, 18 bp, Artificial Sequence
  Description of Artificial Sequence: Synthetic oligonucleotide
acctatcaggaaacctat

SEQ ID NO: 2196 - DNA, 96 bp, Artificial Sequence; identical to SEQ ID NO: 2158
  Description of Artificial Sequence: Synthetic oligonucleotide

SEQ ID NO: 2197 - DNA, 42 bp, Artificial Sequence; identical to SEQ ID NO: 2159
  Description of Artificial Sequence: Synthetic oligonucleotide

SEQ ID NO: 2198 - DNA, 42 bp, Artificial Sequence; identical to SEQ ID NO: 2160
  Description of Artificial Sequence: Synthetic oligonucleotide

SEQ ID NO: 2199 - DNA, 87 bp, Artificial Sequence; identical to SEQ ID NO: 2161
  Description of Artificial Sequence: Synthetic oligonucleotide

SEQ ID NO: 2200 - DNA, 33 bp, Artificial Sequence; identical to SEQ ID NO: 2162
  Description of Artificial Sequence: Synthetic oligonucleotide

SEQ ID NO: 2201 - DNA, 33 bp, Artificial Sequence; identical to SEQ ID NO: 2163
  Description of Artificial Sequence: Synthetic oligonucleotide

SEQ ID NO: 2202 - DNA, 51 bp, Artificial Sequence; identical to SEQ ID NO: 2164
  Description of Artificial Sequence: Synthetic oligonucleotide

SEQ ID NO: 2203 - DNA, 27 bp, Artificial Sequence
  Description of Artificial Sequence: Synthetic oligonucleotide
cagcatgattataccgcgaccgatgaa

SEQ ID NO: 2204 - DNA, 30 bp, Artificial Sequence; identical to SEQ ID NO: 2166
  Description of Artificial Sequence: Synthetic oligonucleotide

SEQ ID NO: 2205 - DNA, 33 bp, Artificial Sequence; identical to SEQ ID NO: 2167
  Description of Artificial Sequence: Synthetic oligonucleotide

SEQ ID NO: 2206 - DNA, 39 bp, Artificial Sequence
  Description of Artificial Sequence: Synthetic oligonucleotide
aaatggaccctggaacgtctgaaacgtaaataccgtaac

SEQ ID NO: 2207 - DNA, 51 bp, Artificial Sequence
  Description of Artificial Sequence: Synthetic oligonucleotide
acctggcgtgttcagcgttctcagaacccgctgaaaatccgtctgacccgt

SEQ ID NO: 2208 - DNA, 36 bp, Artificial Sequence
  Description of Artificial Sequence: Synthetic oligonucleotide
accatgcgcggcaaaaaaaaacgcacccgcgcgaac

SEQ ID NO: 2209 - DNA, 45 bp, Artificial Sequence
  Description of Artificial Sequence: Synthetic oligonucleotide
agctatagctatgatgcgccgagcgattttattaactttagcagc

SEQ ID NO: 2210 - DNA, 111 bp, Artificial Sequence
  Description of Artificial Sequence: Synthetic polynucleotide
agctatagctatgatgcgccgagcgattttattaactttagcagcctggatgatgaaggcgatacccagaacattgatagctggtttgaagaaaaagcgaacctggaaaac

SEQ ID NO: 2211 - DNA, 75 bp, Artificial Sequence
  Description of Artificial Sequence: Synthetic oligonucleotide
atgagccaggtgaagtcatcttattcctatgatgcccccagcgatttcatcaatttttcatccttggatgatgaa

SEQ ID NO: 2212 - DNA, 93 bp, Artificial Sequence
  Description of Artificial Sequence: Synthetic oligonucleotide
atggcgctgagcccgagccgcggctttgcggaacatagcagcgaaccgccgagctgggtgaccattatgctgtatgaaaacgaactgtggatt

SEQ ID NO: 2213 - DNA, 87 bp, Artificial Sequence
  Description of Artificial Sequence: Synthetic oligonucleotide
ctggaatttgatagcctgcagccgtgcttttatccggatgaagatgatttttattttggcggcccggatagcaccccgccgggcgaa

SEQ ID NO: 2214 - DNA, 45 bp, Artificial Sequence
  Description of Artificial Sequence: Synthetic oligonucleotide
cgcctgtatggctttaaaattcatccgatggcgtatcagctgcag

SEQ ID NO: 2215 - DNA, 57 bp, Artificial Sequence
  Description of Artificial Sequence: Synthetic oligonucleotide
gaaccgccgctgaacccgcatggcagcgcgcgcgcggaagtgcatctgcgcaaaagc

SEQ ID NO: 2216 - DNA, 60 bp, Artificial Sequence
  Description of Artificial Sequence: Synthetic oligonucleotide
agcgcggtgatggaacgcctgcgccgccgcattgaactgtgccgccgccatcatagcacc

SEQ ID NO: 2217 - DNA, 60 bp, Artificial Sequence
  Description of Artificial Sequence: Synthetic oligonucleotide
acctataccaaaaaacaggtgctgcgcatggaacatctggtgctgaaagtgctgaccttt

SEQ ID NO: 2218 - DNA, 60 bp, Artificial Sequence
  Description of Artificial Sequence: Synthetic oligonucleotide
ctggtgtgcaaaagctatcgcctggattgggaagcgggcgcgctgtttcgcagcctgttt

SEQ ID NO: 2219 - DNA, 60 bp, Artificial Sequence
  Description of Artificial Sequence: Synthetic oligonucleotide
tatagctttgtgcatcatggcttttttaactttcgcgtgagctggcgcgaaatgctggcg

SEQ ID NO: 2220 - DNA, 15 bp, Artificial Sequence
  Description of Artificial Sequence: Synthetic oligonucleotide
accgcggcgctgagc

SEQ ID NO: 2221 - DNA, 15 bp, Artificial Sequence
  Description of Artificial Sequence: Synthetic oligonucleotide
accgcgctgctgagc

SEQ ID NO: 2222 - DNA, 15 bp, Artificial Sequence
  Description of Artificial Sequence: Synthetic oligonucleotide
ctggcggcgctgagc

SEQ ID NO: 2223 - DNA, 15 bp, Artificial Sequence
  Description of Artificial Sequence: Synthetic oligonucleotide
gatgcggcgctgacc

SEQ ID NO: 2224 - DNA, 15 bp, Artificial Sequence
  Description of Artificial Sequence: Synthetic oligonucleotide
tatgcggcgctgcag

SEQ ID NO: 2225 - DNA, 33 bp, Artificial Sequence
  Description of Artificial Sequence: Synthetic oligonucleotide
  modified_base (10)..(12): n is a, c, g, or t
agcaaactgnnncgctttaccggctgcagctgc

SEQ ID NO: 2226 - DNA, 24 bp, Artificial Sequence
  Description of Artificial Sequence: Synthetic oligonucleotide
ccggtgaaacgccgcctgtttctg

SEQ ID NO: 2227 - DNA, 78 bp, Artificial Sequence
  Description of Artificial Sequence: Synthetic oligonucleotide
ggccgcaaacgccgccagaccagcatgaccgatttttatcatagcaaacgccgcctgatttttagcaaacgcaaaccg

SEQ ID NO: 2228 - DNA, 48 bp, Artificial Sequence
  Description of Artificial Sequence: Synthetic oligonucleotide
atggcgggcccgatgcagaccagcaccccgaaaaacgcgggcaaaaaa

SEQ ID NO: 2229 - DNA, 27 bp, Artificial Sequence
  Description of Artificial Sequence: Synthetic oligonucleotide
tttgatccgccgctgcatagcaccgcg

SEQ ID NO: 2230 - DNA, 21 bp, Artificial Sequence
  Description of Artificial Sequence: Synthetic oligonucleotide
ccgctgcatagcaccgcgatt

SEQ ID NO: 2231 - DNA, 18 bp, Artificial Sequence
  Description of Artificial Sequence: Synthetic oligonucleotide
atggatagcaccccgctg

SEQ ID NO: 2232 - DNA, 24 bp, Artificial Sequence
  Description of Artificial Sequence: Synthetic oligonucleotide
tttagccagcataaaaccagcatt

SEQ ID NO: 2233 - DNA, 33 bp, Artificial Sequence
  Description of Artificial Sequence: Synthetic oligonucleotide
ctgcattatccgagcaccaccgcgctgcaggaa

SEQ ID NO: 2234 - DNA, 27 bp, Artificial Sequence
  Description of Artificial Sequence: Synthetic oligonucleotide
ctgctgtgcagcaccccgaacggcctg

SEQ ID NO: 2235 - DNA, 36 bp, Artificial Sequence
  Description of Artificial Sequence: Synthetic oligonucleotide
gaagcgatttatgcggcgccgtttgcgaaaaaaaaa

SEQ ID NO: 2236 - DNA, 27 bp, Artificial Sequence
  Description of Artificial Sequence: Synthetic oligonucleotide
gcgccgagctatccgccgccgccgccg

SEQ ID NO: 2237 - DNA, 24 bp, Artificial Sequence
  Description of Artificial Sequence: Synthetic oligonucleotide
ctgcagaccattcaggaagaagaa

SEQ ID NO: 2238 - DNA, 12 bp, Artificial Sequence
  Description of Artificial Sequence: Synthetic oligonucleotide
  modified_base (7)..(9): n is a, c, g, or t
cgcgtgnnnttt

SEQ ID NO: 2239 - DNA, 12 bp, Artificial Sequence
  Description of Artificial Sequence: Synthetic oligonucleotide
agcattctgaaa

SEQ ID NO: 2240 - DNA, 45 bp, Artificial Sequence
  Description of Artificial Sequence: Synthetic oligonucleotide
agccgccgcgtgagctttgcggataccattaaagtgtttcagacc

SEQ ID NO: 2241 - DNA, 81 bp, Artificial Sequence
  Description of Artificial Sequence: Synthetic oligonucleotide
tttagcagcaaccgccagaaaattctggaacgcaccgaaattctgaaccaggaatggaaacagcgccgcattcagccggtg

SEQ ID NO: 2242 - DNA, 63 bp, Artificial Sequence
  Description of Artificial Sequence: Synthetic oligonucleotide
aaagcgctggaaaccctgcgccgcgtgggcgatggcgtgcagcgcaaccatgaaaccgcgttt

SEQ ID NO: 2243 - DNA, 75 bp, Artificial Sequence
  Description of Artificial Sequence: Synthetic oligonucleotide
gcggaactggaagtggaaagcgcgacccagctgcgccgctttggcgataaactgaactttcgccagaaactgctg

SEQ ID NO: 2244 - DNA, 63 bp, Artificial Sequence
  Description of Artificial Sequence: Synthetic oligonucleotide
  modified_base (22)..(24): n is a, c, g, or t
  modified_base (34)..(36): n is a, c, g, or t
aaagcgctggaaaccctgcgcnnngtgggcgatnnngtgcagcgcaaccatgaaaccgcgttt

SEQ ID NO: 2245 - DNA, 33 bp, Artificial Sequence
  Description of Artificial Sequence: Synthetic oligonucleotide
aaagaagcgccgccggcgccgccgcaggatccg

SEQ ID NO: 2246 - DNA, 24 bp, Artificial Sequence
  Description of Artificial Sequence: Synthetic oligonucleotide
ctgagccgccgcccggattatcgc

SEQ ID NO: 2247 - DNA, 42 bp, Artificial Sequence
  Description of Artificial Sequence: Synthetic oligonucleotide
cgccgcgaaggcggcatgagccgcccggcggatgtggatggc

SEQ ID NO: 2248 - DNA, 78 bp, Artificial Sequence
  Description of Artificial Sequence: Synthetic oligonucleotide
tatcgccgcgcggcggtgccgccgagcccgagcctgagccgccatagcagcccgagccaggatgaagatgaagaagaa

SEQ ID NO: 2249 - DNA, 27 bp, Artificial Sequence
  Description of Artificial Sequence: Synthetic oligonucleotide
agcggctggaccgtggtgcgcatgtat

SEQ ID NO: 2250 - DNA, 24 bp, Artificial Sequence
  Description of Artificial Sequence: Synthetic oligonucleotide
cgtgaagccggtgatggtgaagaa

SEQ ID NO: 2251 - DNA, 42 bp, Artificial Sequence; identical to SEQ ID NO: 81
  Description of Artificial Sequence: Synthetic oligonucleotide

SEQ ID NO: 2252 - DNA, 63 bp, Artificial Sequence
  Description of Artificial Sequence: Synthetic oligonucleotide
atttggattgcgcaggaactgcgccgcattggcgatgaatttaacgcgtattatgcgcgccgc

SEQ ID NO: 2253 - DNA, 48 bp, Artificial Sequence
  Description of Artificial Sequence: Synthetic oligonucleotide
ggccaggtgggccgccagctggcgattattggcgatgatattaaccgc

SEQ ID NO: 2254 - DNA, 75 bp, Artificial Sequence
  Description of Artificial Sequence: Synthetic oligonucleotide
aacctgtgggcggcgcagcgctatggccgcgaactgcgccgcatgagcgatgaatttgtggatagctttaaaaaa

SEQ ID NO: 2255 - DNA, 126 bp, Artificial Sequence
  Description of Artificial Sequence: Synthetic polynucleotide
agcatcgccgccaccctggagaaggaggaggccaacctggagaagatgaacaagaagctggccgccgagatcgagagcctgctgaaggagaaggacaagctggagagcgtgctgaactaccacgag

SEQ ID NO: 2256 - DNA, 96 bp, Artificial Sequence
  Description of Artificial Sequence: Synthetic oligonucleotide
gttcaggaaatcgaacaggaaatccaggaactggaaaaacgtatcaaacagatccagcaggaattccaggaaatcgaacagcagatcgcgctgctg

SEQ ID NO: 2257 - DNA, 45 bp, Artificial Sequence
  Description of Artificial Sequence: Synthetic oligonucleotide
gcgacccagctgcgccgctttggcgataaactgaactttcgccag

SEQ ID NO: 2258 - DNA, 60 bp, Artificial Sequence
  Description of Artificial Sequence: Synthetic oligonucleotide
gaaattgtggcgaaatatattcattataaactgagccagcgcggctatgaatgggatgcg

SEQ ID NO: 2259 - DNA, 42 bp, Artificial Sequence
  Description of Artificial Sequence: Synthetic oligonucleotide
aaaaaacgctatgatcgcgaatttctgctgggctttcagttt

SEQ ID NO: 2260 - DNA, 102 bp, Artificial Sequence
  Description of Artificial Sequence: Synthetic polynucleotide
ggcaaaaaacgctatgatcgcgaatttctgctgggctttcagtttatttttgcgagcatgcagaaaccggaaggcctgccgcatattagcgatgtggtgctg

SEQ ID NO: 2261 - DNA, 102 bp, Artificial Sequence
  Description of Artificial Sequence: Synthetic polynucleotide
accaaactgatttatgaacgcgcgtttatgaaaaacctgcgcggcagcccgctgagccagaccccgccgagcaacgtgccgagctgcctgctgcgcggcacc

SEQ ID NO: 2262 - DNA, 108 bp, Artificial Sequence
  Description of Artificial Sequence: Synthetic polynucleotide
gcgattgcgcgcctggaagaacgcgtgaaaaccctgaaagcggaaatttatgaactgcgcagcaaagcgaacatgctgcgcgaacagattgcgcagctgggcgcgccg

SEQ ID NO: 2263 - DNA, 108 bp, Artificial Sequence; identical to SEQ ID NO: 2262
  Description of Artificial Sequence: Synthetic polynucleotide

SEQ ID NO: 2264 - DNA, 45 bp, Artificial Sequence
  Description of Artificial Sequence: Synthetic oligonucleotide
cacatccgtggttctatcacccagggtatcccgcgttcttacgtt

SEQ ID NO: 2265 - DNA, 27 bp, Artificial Sequence
  Description of Artificial Sequence: Synthetic oligonucleotide
ggccgcagcattcatgaaattccgcgc

SEQ ID NO: 2266 - DNA, 63 bp, Artificial Sequence
  Description of Artificial Sequence: Synthetic oligonucleotide
ggcctggtggcgaccgtgaaagaagcgggccgcagcattcatgaaattccgcgcgaagaactg

SEQ ID NO: 2267 - DNA, 36 bp, Artificial Sequence
  Description of Artificial Sequence: Synthetic oligonucleotide
aaagattatgaagaagtgggcgtggatagcgtggaa

SEQ ID NO: 2268 - DNA, 39 bp, Artificial Sequence
  Description of Artificial Sequence: Synthetic oligonucleotide
tatcagcagtatcaggatgcgaccgcggatgaacagggc

SEQ ID NO: 2269 - DNA, 60 bp, Artificial Sequence
  Description of Artificial Sequence: Synthetic oligonucleotide
gatgcggtgcgccgcattgaagatatgatgaaccaggcgcgccatgcgagcagcggcgtg

SEQ ID NO: 2270 - DNA, 39 bp, Artificial Sequence
  Description of Artificial Sequence: Synthetic oligonucleotide
tacgtttacaacacccgttctggttggcgttggtacacc

SEQ ID NO: 2271 - DNA, 51 bp, Artificial Sequence
  Description of Artificial Sequence: Synthetic oligonucleotide
gtgcgcaaacgcaccctgcgccgcctgctgcaggaacgcgaactggtggaa

SEQ ID NO: 2272 - DNA, 84 bp, Artificial Sequence
  Description of Artificial Sequence: Synthetic oligonucleotide
cgccaggtgcgcgaactggaaaactatattgatcgcctggtgcgcgtgatggaagaaaccccgaacattctgcgcattccgcgc

SEQ ID NO: 2273 - DNA, 33 bp, Artificial Sequence
  Description of Artificial Sequence: Synthetic oligonucleotide
cgcgcgagccagtattttagcagctatctggcg

SEQ ID NO: 2274 - DNA, 48 bp, Artificial Sequence
  Description of Artificial Sequence: Synthetic oligonucleotide
gcgcgcgaagattttcgcaaccgccgcctgtggtatgtgatggattat

SEQ ID NO: 2275 - DNA, 39 bp, Artificial Sequence
  Description of Artificial Sequence: Synthetic oligonucleotide
aaagcgagcggctatagctttaccgattattttatttat

SEQ ID NO: 2276 - DNA, 24 bp, Artificial Sequence
  Description of Artificial Sequence: Synthetic oligonucleotide
tatcgcgatcgccgccgcccgagc

SEQ ID NO: 2277 - DNA, 39 bp, Artificial Sequence
  Description of Artificial Sequence: Synthetic oligonucleotide
agcggcagcagcagcgatattggcagcaactatgtgagc

SEQ ID NO: 2278 - DNA, 27 bp, Artificial Sequence
  Description of Artificial Sequence: Synthetic oligonucleotide
cagcagtggagcagccatatttttacc

SEQ ID NO: 2279 - DNA, 42 bp, Artificial Sequence
  Description of Artificial Sequence: Synthetic oligonucleotide
gcgagccgcgattatgattatgcgggccgctattttgattat

SEQ ID NO: 2280 - DNA, 27 bp, Artificial Sequence
  Description of Artificial Sequence: Synthetic oligonucleotide
cagaacggccatagctttccgtttacc

SEQ ID NO: 2281 - DNA, 30 bp, Artificial Sequence
  Description of Artificial Sequence: Synthetic oligonucleotide
tatattaacccgtataacgatggcaccaaa

SEQ ID NO: 2282 - DNA, 24 bp, Artificial Sequence
  Description of Artificial Sequence: Synthetic oligonucleotide
gcgcgcaactgggatgtggcgtat

SEQ ID NO: 2283 - DNA, 33 bp, Artificial Sequence
  Description of Artificial Sequence: Synthetic oligonucleotide
agcggctatagctttaccggccattggatgaac

SEQ ID NO: 2284 - DNA, 30 bp, Artificial Sequence
  Description of Artificial Sequence: Synthetic oligonucleotide
atgattcatccgagcgatagcgaaacccgc

SEQ ID NO: 2285 - DNA, 42 bp, Artificial Sequence
  Description of Artificial Sequence: Synthetic oligonucleotide
gcgcgcggcatttatttttatggcaccacctattttgattat

SEQ ID NO: 2286 - DNA, 30 bp, Artificial Sequence
  Description of Artificial Sequence: Synthetic oligonucleotide
agcggctttagctttaccagcagcgtgagc

SEQ ID NO: 2287 - DNA, 27 bp, Artificial Sequence
  Description of Artificial Sequence: Synthetic oligonucleotide
ctgatttatccgtataacggctttaac

SEQ ID NO: 2288 - DNA, 39 bp, Artificial Sequence
  Description of Artificial Sequence: Synthetic oligonucleotide
gcggcgagcggctttacctttaccagcaccggcattagc

SEQ ID NO: 2289 - DNA, 45 bp, Artificial Sequence
  Description of Artificial Sequence: Synthetic oligonucleotide
gcgcgcacctatggcatttatgatctgtatgtggattataccgaa

SEQ ID NO: 2290 - DNA, 27 bp, Artificial Sequence
  Description of Artificial Sequence: Synthetic oligonucleotide
agccgcgattatggctattattttgat

SEQ ID NO: 2291 - DNA, 30 bp, Artificial Sequence
  Description of Artificial Sequence: Synthetic oligonucleotide
ggctatagctttacccgctattggatgcat

SEQ ID NO: 2292 - DNA, 24 bp, Artificial Sequence
  Description of Artificial Sequence: Synthetic oligonucleotide
cagtggtggtggtggccgagcacc

SEQ ID NO: 2293 - DNA, 36 bp, Artificial Sequence
  Description of Artificial Sequence: Synthetic oligonucleotide
gcgagcggctttagcatttggtggagctggattcat

SEQ ID NO: 2294 - DNA, 24 bp, Artificial Sequence
  Description of Artificial Sequence: Synthetic oligonucleotide
tatgataacaaccagcgcccgagc

SEQ ID NO: 2295 - DNA, 51 bp, Artificial Sequence
  Description of Artificial Sequence: Synthetic oligonucleotide
acctttcatattcgccgctatcgcagcggctattatgataaaatggatcat

SEQ ID NO: 2296 - DNA, 36 bp, Artificial Sequence
  Description of Artificial Sequence: Synthetic oligonucleotide
gcgcgcggcccgtttagcccgtgggtgatggattat

SEQ ID NO: 2297 - DNA, 27 bp, Artificial Sequence
  Description of Artificial Sequence: Synthetic oligonucleotide
acccgccatgatggcaccaactttgat

SEQ ID NO: 2298 - DNA, 27 bp, Artificial Sequence
  Description of Artificial Sequence: Synthetic oligonucleotide
cagcaggcgaaagcgtttccgccgacc

SEQ ID NO: 2299 - DNA, 36 bp, Artificial Sequence
  Description of Artificial Sequence: Synthetic oligonucleotide
agcggccatgtgaacgcggtgaaaaactatggctat

SEQ ID NO: 2300 - DNA, 24 bp, Artificial Sequence
  Description of Artificial Sequence: Synthetic oligonucleotide
tggattaacaccgaaaccggcagc

SEQ ID NO: 2301 - DNA, 24 bp, Artificial Sequence
  Description of Artificial Sequence: Synthetic oligonucleotide
tggattaacacctataccggcgaa

SEQ ID NO: 2302 - DNA, 30 bp, Artificial Sequence
  Description of Artificial Sequence: Synthetic oligonucleotide
ggctatacctttaccaactatggcatgaac

SEQ ID NO: 2303 - DNA, 39 bp, Artificial Sequence; identical to SEQ ID NO: 2206
  Description of Artificial Sequence: Synthetic oligonucleotide

SEQ ID NO: 2304 - DNA, 51 bp, Artificial Sequence; identical to SEQ ID NO: 2207
  Description of Artificial Sequence: Synthetic oligonucleotide

SEQ ID NO: 2305 - DNA, 36 bp, Artificial Sequence; identical to SEQ ID NO: 2208
  Description of Artificial Sequence: Synthetic oligonucleotide

SEQ ID NO: 2306 - DNA, 45 bp, Artificial Sequence; identical to SEQ ID NO: 2209
  Description of Artificial Sequence: Synthetic oligonucleotide

SEQ ID NO: 2307 - DNA, 111 bp, Artificial Sequence; identical to SEQ ID NO: 2210
  Description of Artificial Sequence: Synthetic polynucleotide

SEQ ID NO: 2308 - DNA, 75 bp, Artificial Sequence; identical to SEQ ID NO: 2211
  Description of Artificial Sequence: Synthetic oligonucleotide

SEQ ID NO: 2309 - DNA, 93 bp, Artificial Sequence; identical to SEQ ID NO: 2212
  Description of Artificial Sequence: Synthetic oligonucleotide

SEQ ID NO: 2310 - DNA, 87 bp, Artificial Sequence; identical to SEQ ID NO: 2213
  Description of Artificial Sequence: Synthetic oligonucleotide

SEQ ID NO: 2311 - DNA, 45 bp, Artificial Sequence; identical to SEQ ID NO: 2214
  Description of Artificial Sequence: Synthetic oligonucleotide

SEQ ID NO: 2312 - DNA, 57 bp, Artificial Sequence; identical to SEQ ID NO: 2215
  Description of Artificial Sequence: Synthetic oligonucleotide

SEQ ID NO: 2313 - DNA, 60 bp, Artificial Sequence; identical to SEQ ID NO: 2216
  Description of Artificial Sequence: Synthetic oligonucleotide

SEQ ID NO: 2314 - DNA, 60 bp, Artificial Sequence; identical to SEQ ID NO: 2217
  Description of Artificial Sequence: Synthetic oligonucleotide

SEQ ID NO: 2315 - DNA, 60 bp, Artificial Sequence; identical to SEQ ID NO: 2218
  Description of Artificial Sequence: Synthetic oligonucleotide

SEQ ID NO: 2316 - DNA, 60 bp, Artificial Sequence; identical to SEQ ID NO: 2219
  Description of Artificial Sequence: Synthetic oligonucleotide

SEQ ID NO: 2317 - DNA, 15 bp, Artificial Sequence
  Description of Artificial Sequence: Synthetic oligonucleotide
accgcggcgctgagc

SEQ ID NO: 2318 - DNA, 15 bp, Artificial Sequence
  Description of Artificial Sequence: Synthetic oligonucleotide
accgcgctgctgagc

SEQ ID NO: 2319 - DNA, 15 bp, Artificial Sequence
  Description of Artificial Sequence: Synthetic oligonucleotide
ctggcggcgctgagc

SEQ ID NO: 2320 - DNA, 15 bp, Artificial Sequence
  Description of Artificial Sequence: Synthetic oligonucleotide
gatgcggcgctgacc

SEQ ID NO: 2321 - DNA, 15 bp, Artificial Sequence
  Description of Artificial Sequence: Synthetic oligonucleotide
tatgcggcgctgcag

SEQ ID NO: 2322 - DNA, 33 bp, Artificial Sequence; identical to SEQ ID NO: 2225
  Description of Artificial Sequence: Synthetic oligonucleotide
  modified_base (10)..(12): n is a, c, g, or t

SEQ ID NO: 2323 - DNA, 24 bp, Artificial Sequence
  Description of Artificial Sequence: Synthetic oligonucleotide
ccggtgaaacgccgcctgtttctg

SEQ ID NO: 2324 - DNA, 78 bp, Artificial Sequence; identical to SEQ ID NO: 2227
  Description of Artificial Sequence: Synthetic oligonucleotide

SEQ ID NO: 2325 - DNA, 48 bp, Artificial Sequence; identical to SEQ ID NO: 2228
  Description of Artificial Sequence: Synthetic oligonucleotide

SEQ ID NO: 2326 - DNA, 27 bp, Artificial Sequence
  Description of Artificial Sequence: Synthetic oligonucleotide
tttgatccgccgctgcatagcaccgcg

SEQ ID NO: 2327 - DNA, 21 bp, Artificial Sequence
  Description of Artificial Sequence: Synthetic oligonucleotide
ccgctgcatagcaccgcgatt

SEQ ID NO: 2328 - DNA, 18 bp, Artificial Sequence
  Description of Artificial Sequence: Synthetic oligonucleotide
atggatagcaccccgctg

SEQ ID NO: 2329 - DNA, 24 bp, Artificial Sequence
  Description of Artificial Sequence: Synthetic oligonucleotide
tttagccagcataaaaccagcatt

SEQ ID NO: 2330 - DNA, 33 bp, Artificial Sequence; identical to SEQ ID NO: 2233
  Description of Artificial Sequence: Synthetic oligonucleotide

SEQ ID NO: 2331 - DNA, 27 bp, Artificial Sequence
  Description of Artificial Sequence: Synthetic oligonucleotide
ctgctgtgcagcaccccgaacggcctg

SEQ ID NO: 2332 - DNA, 36 bp, Artificial Sequence; identical to SEQ ID NO: 2235
  Description of Artificial Sequence: Synthetic oligonucleotide

SEQ ID NO: 2333 - DNA, 27 bp, Artificial Sequence
  Description of Artificial Sequence: Synthetic oligonucleotide
gcgccgagctatccgccgccgccgccg

SEQ ID NO: 2334 - DNA, 24 bp, Artificial Sequence
  Description of Artificial Sequence: Synthetic oligonucleotide
ctgcagaccattcaggaagaagaa

SEQ ID NO: 2335 - DNA, 12 bp, Artificial Sequence
  Description of Artificial Sequence: Synthetic oligonucleotide
  modified_base (7)..(9): n is a, c, g, or t
cgcgtgnnnttt

SEQ ID NO: 2336 - DNA, 12 bp, Artificial Sequence
  Description of Artificial Sequence: Synthetic oligonucleotide
agcattctgaaa

SEQ ID NO: 2337 - DNA, 45 bp, Artificial Sequence; identical to SEQ ID NO: 2240
  Description of Artificial Sequence: Synthetic oligonucleotide

SEQ ID NO: 2338 - DNA, 81 bp, Artificial Sequence; identical to SEQ ID NO: 2241
  Description of Artificial Sequence: Synthetic oligonucleotide

SEQ ID NO: 2339 - DNA, 63 bp, Artificial Sequence; identical to SEQ ID NO: 2242
  Description of Artificial Sequence: Synthetic oligonucleotide

SEQ ID NO: 2340 - DNA, 75 bp, Artificial Sequence; identical to SEQ ID NO: 2243
  Description of Artificial Sequence: Synthetic oligonucleotide

SEQ ID NO: 2341 - DNA, 63 bp, Artificial Sequence; identical to SEQ ID NO: 2244
  Description of Artificial Sequence: Synthetic oligonucleotide
  modified_base (22)..(24): n is a, c, g, or t
  modified_base (34)..(36): n is a, c, g, or t

SEQ ID NO: 2342 - DNA, 57 bp, Artificial Sequence; identical to SEQ ID NO: 65
  Description of Artificial Sequence: Synthetic oligonucleotide

SEQ ID NO: 2343 - DNA, 66 bp, Artificial Sequence; identical to SEQ ID NO: 67
  Description of Artificial Sequence: Synthetic oligonucleotide

SEQ ID NO: 2344 - DNA, 57 bp, Artificial Sequence; identical to SEQ ID NO: 69
  Description of Artificial Sequence: Synthetic oligonucleotide

SEQ ID NO: 2345 - DNA, 48 bp, Artificial Sequence; identical to SEQ ID NO: 71
  Description of Artificial Sequence: Synthetic oligonucleotide

SEQ ID NO: 2346 - DNA, 42 bp, Artificial Sequence; identical to SEQ ID NO: 73
  Description of Artificial Sequence: Synthetic oligonucleotide

SEQ ID NO: 2347 - DNA, 48 bp, Artificial Sequence; identical to SEQ ID NO: 75
  Description of Artificial Sequence: Synthetic oligonucleotide

SEQ ID NO: 2348 - DNA, 93 bp, Artificial Sequence; identical to SEQ ID NO: 2136
  Description of Artificial Sequence: Synthetic oligonucleotide

SEQ ID NO: 2349 - DNA, 60 bp, Artificial Sequence; identical to SEQ ID NO: 2137
  Description of Artificial Sequence: Synthetic oligonucleotide

SEQ ID NO: 2350 - DNA, 171 bp, Artificial Sequence; identical to SEQ ID NO: 2138
  Description of Artificial Sequence: Synthetic polynucleotide

SEQ ID NO: 2351 - DNA, 27 bp, Artificial Sequence
  Description of Artificial Sequence: Synthetic oligonucleotide
  modified_base (4)..(9): n is a, c, g, or t
gatnnnnnngaatttgatcagtatctg

SEQ ID NO: 2352 - DNA, 99 bp, Artificial Sequence; identical to SEQ ID NO: 2140
  Description of Artificial Sequence: Synthetic oligonucleotide

SEQ ID NO: 2353 - DNA, 45 bp, Artificial Sequence; identical to SEQ ID NO: 77
  Description of Artificial Sequence: Synthetic oligonucleotide

SEQ ID NO: 2354 - DNA, 18 bp, Artificial Sequence
  Description of Artificial Sequence: Synthetic oligonucleotide
cccctgtacatcagctac

SEQ ID NO: 2355 - DNA, 57 bp, Artificial Sequence; identical to SEQ ID NO: 2143
  Description of Artificial Sequence: Synthetic oligonucleotide

SEQ ID NO: 2356 - DNA, 60 bp, Artificial Sequence; identical to SEQ ID NO: 2144
  Description of Artificial Sequence: Synthetic oligonucleotide

SEQ ID NO: 2357 - DNA, 66 bp, Artificial Sequence; identical to SEQ ID NO: 2145
  Description of Artificial Sequence: Synthetic oligonucleotide

SEQ ID NO: 2358 - DNA, 36 bp, Artificial Sequence; identical to SEQ ID NO: 2146
  Description of Artificial Sequence: Synthetic oligonucleotide

SEQ ID NO: 2359 - DNA, 33 bp, Artificial Sequence; identical to SEQ ID NO: 2147
  Description of Artificial Sequence: Synthetic oligonucleotide

SEQ ID NO: 2360 - DNA, 30 bp, Artificial Sequence; identical to SEQ ID NO: 2148
  Description of Artificial Sequence: Synthetic oligonucleotide

SEQ ID NO: 2361 - DNA, 30 bp, Artificial Sequence; identical to SEQ ID NO: 2149
  Description of Artificial Sequence: Synthetic oligonucleotide
  modified_base (13)..(18): n is a, c, g, or t
  modified_base (25)..(30): n is a, c, g, or t

SEQ ID NO: 2362 - DNA, 24 bp, Artificial Sequence
  Description of Artificial Sequence: Synthetic oligonucleotide
agcattgtgtttggcgcgcatgat

SEQ ID NO: 2363 - DNA, 27 bp, Artificial Sequence
  Description of Artificial Sequence: Synthetic oligonucleotide
tatggccatggccaggtgtattattat

SEQ ID NO: 2364 - DNA, 18 bp, Artificial Sequence
  Description of Artificial Sequence: Synthetic oligonucleotide
gaaaacccgaaacagaac

SEQ ID NO: 2365 - DNA, 36 bp, Artificial Sequence; identical to SEQ ID NO: 2153
  Description of Artificial Sequence: Synthetic oligonucleotide

SEQ ID NO: 2366 - DNA, 21 bp, Artificial Sequence
  Description of Artificial Sequence: Synthetic oligonucleotide
aaatcccgcgatttctatcat

SEQ ID NO: 2367 - DNA, 48 bp, Artificial Sequence; identical to SEQ ID NO: 2155
  Description of Artificial Sequence: Synthetic oligonucleotide

SEQ ID NO: 2368 - DNA, 75 bp, Artificial Sequence; identical to SEQ ID NO: 2156
  Description of Artificial Sequence: Synthetic oligonucleotide

SEQ ID NO: 2369 - DNA, 18 bp, Artificial Sequence
  Description of Artificial Sequence: Synthetic oligonucleotide
acctatcaggaaacctat

SEQ ID NO: 2370 - DNA, 96 bp, Artificial Sequence; identical to SEQ ID NO: 2158
  Description of Artificial Sequence: Synthetic oligonucleotide

SEQ ID NO: 2371 - DNA, 42 bp, Artificial Sequence; identical to SEQ ID NO: 2159
  Description of Artificial Sequence: Synthetic oligonucleotide

SEQ ID NO: 2372 - DNA, 42 bp, Artificial Sequence; identical to SEQ ID NO: 2160
  Description of Artificial Sequence: Synthetic oligonucleotide

SEQ ID NO: 2373 - DNA, 87 bp, Artificial Sequence; identical to SEQ ID NO: 2161
  Description of Artificial Sequence: Synthetic oligonucleotide

SEQ ID NO: 2374 - DNA, 33 bp, Artificial Sequence; identical to SEQ ID NO: 2162
  Description of Artificial Sequence: Synthetic oligonucleotide

SEQ ID NO: 2375 - DNA, 33 bp, Artificial Sequence; identical to SEQ ID NO: 2163
  Description of Artificial Sequence: Synthetic oligonucleotide

SEQ ID NO: 2376 - DNA, 51 bp, Artificial Sequence; identical to SEQ ID NO: 2164
  Description of Artificial Sequence: Synthetic oligonucleotide

SEQ ID NO: 2377 - DNA, 27 bp, Artificial Sequence
  Description of Artificial Sequence: Synthetic oligonucleotide
cagcatgattataccgcgaccgatgaa

SEQ ID NO: 2378 - DNA, 30 bp, Artificial Sequence; identical to SEQ ID NO: 2166
  Description of Artificial Sequence: Synthetic oligonucleotide

SEQ ID NO: 2379 - DNA, 33 bp, Artificial Sequence; identical to SEQ ID NO: 2167
  Description of Artificial Sequence: Synthetic oligonucleotide

SEQ ID NO: 2380 - DNA, 39 bp, Artificial Sequence; identical to SEQ ID NO: 2206
  Description of Artificial Sequence: Synthetic oligonucleotide

SEQ ID NO: 2381 - DNA, 51 bp, Artificial Sequence; identical to SEQ ID NO: 2207
  Description of Artificial Sequence: Synthetic oligonucleotide

SEQ ID NO: 2382 - DNA, 36 bp, Artificial Sequence; identical to SEQ ID NO: 2208
  Description of Artificial Sequence: Synthetic oligonucleotide

SEQ ID NO: 2383 - DNA, 45 bp, Artificial Sequence; identical to SEQ ID NO: 2209
  Description of Artificial Sequence: Synthetic oligonucleotide

SEQ ID NO: 2384 - DNA, 111 bp, Artificial Sequence; identical to SEQ ID NO: 2210
  Description of Artificial Sequence: Synthetic polynucleotide

SEQ ID NO: 2385 - DNA, 75 bp, Artificial Sequence; identical to SEQ ID NO: 2211
  Description of Artificial Sequence: Synthetic oligonucleotide

SEQ ID NO: 2386 - DNA, 93 bp, Artificial Sequence; identical to SEQ ID NO: 2212
  Description of Artificial Sequence: Synthetic oligonucleotide

SEQ ID NO: 2387 - DNA, 87 bp, Artificial Sequence; identical to SEQ ID NO: 2213
  Description of Artificial Sequence: Synthetic oligonucleotide

SEQ ID NO: 2388 - DNA, 45 bp, Artificial Sequence; identical to SEQ ID NO: 2214
  Description of Artificial Sequence: Synthetic oligonucleotide

SEQ ID NO: 2389 - DNA, 57 bp, Artificial Sequence; identical to SEQ ID NO: 2215
  Description of Artificial Sequence: Synthetic oligonucleotide

SEQ ID NO: 2390 - DNA, 60 bp, Artificial Sequence; identical to SEQ ID NO: 2216
  Description of Artificial Sequence: Synthetic oligonucleotide

SEQ ID NO: 2391 - DNA, 60 bp, Artificial Sequence; identical to SEQ ID NO: 2217
  Description of Artificial Sequence: Synthetic oligonucleotide

SEQ ID NO: 2392 - DNA, 60 bp, Artificial Sequence; identical to SEQ ID NO: 2218
  Description of Artificial Sequence: Synthetic oligonucleotide

SEQ ID NO: 2393 - DNA, 60 bp, Artificial Sequence; identical to SEQ ID NO: 2219
  Description of Artificial Sequence: Synthetic oligonucleotide

SEQ ID NO: 2394 - DNA, 15 bp, Artificial Sequence
  Description of Artificial Sequence: Synthetic oligonucleotide
accgcggcgctgagc

SEQ ID NO: 2395 - DNA, 15 bp, Artificial Sequence
  Description of Artificial Sequence: Synthetic oligonucleotide
accgcgctgctgagc

SEQ ID NO: 2396 - DNA, 15 bp, Artificial Sequence
  Description of Artificial Sequence: Synthetic oligonucleotide
ctggcggcgctgagc

SEQ ID NO: 2397 - DNA, 15 bp, Artificial Sequence
  Description of Artificial Sequence: Synthetic oligonucleotide
gatgcggcgctgacc

SEQ ID NO: 2398 - DNA, 15 bp, Artificial Sequence
  Description of Artificial Sequence: Synthetic oligonucleotide
tatgcggcgctgcag

SEQ ID NO: 2399 - DNA, 33 bp, Artificial Sequence; identical to SEQ ID NO: 2225
  Description of Artificial Sequence: Synthetic oligonucleotide
  modified_base (10)..(12): n is a, c, g, or t

SEQ ID NO: 2400 - DNA, 24 bp, Artificial Sequence
  Description of Artificial Sequence: Synthetic oligonucleotide
ccggtgaaacgccgcctgtttctg

SEQ ID NO: 2401 - DNA, 78 bp, Artificial Sequence; identical to SEQ ID NO: 2227
  Description of Artificial Sequence: Synthetic oligonucleotide

SEQ ID NO: 2402 - DNA, 48 bp, Artificial Sequence; identical to SEQ ID NO: 2228
  Description of Artificial Sequence: Synthetic oligonucleotide

SEQ ID NO: 2403 - DNA, 27 bp, Artificial Sequence
  Description of Artificial Sequence: Synthetic oligonucleotide
tttgatccgccgctgcatagcaccgcg

SEQ ID NO: 2404 - DNA, 21 bp, Artificial Sequence
  Description of Artificial Sequence: Synthetic oligonucleotide
ccgctgcatagcaccgcgatt

SEQ ID NO: 2405 - DNA, 18 bp, Artificial Sequence
  Description of Artificial Sequence: Synthetic oligonucleotide
atggatagcaccccgctg

SEQ ID NO: 2406 - DNA, 24 bp, Artificial Sequence
  Description of Artificial Sequence: Synthetic oligonucleotide
tttagccagcataaaaccagcatt

SEQ ID NO: 2407 - DNA, 33 bp, Artificial Sequence; identical to SEQ ID NO: 2233
  Description of Artificial Sequence: Synthetic oligonucleotide

SEQ ID NO: 2408 - DNA, 27 bp, Artificial Sequence
  Description of Artificial Sequence: Synthetic oligonucleotide
ctgctgtgcagcaccccgaacggcctg

SEQ ID NO: 2409 - DNA, 36 bp, Artificial Sequence; identical to SEQ ID NO: 2235
  Description of Artificial Sequence: Synthetic oligonucleotide

SEQ ID NO: 2410 - DNA, 27 bp, Artificial Sequence
  Description of Artificial Sequence: Synthetic oligonucleotide
gcgccgagctatccgccgccgccgccg

SEQ ID NO: 2411 - DNA, 24 bp, Artificial Sequence
  Description of Artificial Sequence: Synthetic oligonucleotide
ctgcagaccattcaggaagaagaa

SEQ ID NO: 2412 - DNA, 12 bp, Artificial Sequence
  Description of Artificial Sequence: Synthetic oligonucleotide
  modified_base (7)..(9): n is a, c, g, or t
cgcgtgnnnttt

SEQ ID NO: 2413 - DNA, 12 bp, Artificial Sequence
  Description of Artificial Sequence: Synthetic oligonucleotide
agcattctgaaa

SEQ ID NO: 2414 - DNA, 45 bp, Artificial Sequence; identical to SEQ ID NO: 2240
  Description of Artificial Sequence: Synthetic oligonucleotide

SEQ ID NO: 2415 - DNA, 81 bp, Artificial Sequence; identical to SEQ ID NO: 2241
  Description of Artificial Sequence: Synthetic oligonucleotide

SEQ ID NO: 2416 - DNA, 63 bp, Artificial Sequence; identical to SEQ ID NO: 2242
  Description of Artificial Sequence: Synthetic oligonucleotide

SEQ ID NO: 2417 - DNA, 75 bp, Artificial Sequence; identical to SEQ ID NO: 2243
  Description of Artificial Sequence: Synthetic oligonucleotide

SEQ ID NO: 2418 - DNA, 63 bp, Artificial Sequence; identical to SEQ ID NO: 2244
  Description of Artificial Sequence: Synthetic oligonucleotide
  modified_base (22)..(24): n is a, c, g, or t
  modified_base (34)..(36): n is a, c, g, or t

SEQ ID NO: 2419 - DNA, 33 bp, Artificial Sequence; identical to SEQ ID NO: 2245
  Description of Artificial Sequence: Synthetic oligonucleotide

SEQ ID NO: 2420 - DNA, 24 bp, Artificial Sequence
  Description of Artificial Sequence: Synthetic oligonucleotide
ctgagccgccgcccggattatcgc

SEQ ID NO: 2421 - DNA, 42 bp, Artificial Sequence; identical to SEQ ID NO: 2247
  Description of Artificial Sequence: Synthetic oligonucleotide

SEQ ID NO: 2422 - DNA, 78 bp, Artificial Sequence; identical to SEQ ID NO: 2248
  Description of Artificial Sequence: Synthetic oligonucleotide

SEQ ID NO: 2423 - DNA, 27 bp, Artificial Sequence
  Description of Artificial Sequence: Synthetic oligonucleotide
agcggctggaccgtggtgcgcatgtat

SEQ ID NO: 2424 - DNA, 24 bp, Artificial Sequence
  Description of Artificial Sequence: Synthetic oligonucleotide
cgtgaagccggtgatggtgaagaa

SEQ ID NO: 2425 - DNA, 42 bp, Artificial Sequence; identical to SEQ ID NO: 81
  Description of Artificial Sequence: Synthetic oligonucleotide

SEQ ID NO: 2426 - DNA, 63 bp, Artificial Sequence; identical to SEQ ID NO: 2252
  Description of Artificial Sequence: Synthetic oligonucleotide

SEQ ID NO: 2427 - DNA, 48 bp, Artificial Sequence; identical to SEQ ID NO: 2253
  Description of Artificial Sequence: Synthetic oligonucleotide

SEQ ID NO: 2428 - DNA, 75 bp, Artificial Sequence; identical to SEQ ID NO: 2254
  Description of Artificial Sequence: Synthetic oligonucleotide

SEQ ID NO: 2429 - DNA, 126 bp, Artificial Sequence; identical to SEQ ID NO: 2255
  Description of Artificial Sequence: Synthetic polynucleotide

SEQ ID NO: 2430 - DNA, 96 bp, Artificial Sequence; identical to SEQ ID NO: 2256
  Description of Artificial Sequence: Synthetic oligonucleotide

SEQ ID NO: 2431 - DNA, 45 bp, Artificial Sequence; identical to SEQ ID NO: 2257
  Description of Artificial Sequence: Synthetic oligonucleotide

SEQ ID NO: 2432 - DNA, 60 bp, Artificial Sequence; identical to SEQ ID NO: 2258
  Description of Artificial Sequence: Synthetic oligonucleotide

SEQ ID NO: 2433 - DNA, 42 bp, Artificial Sequence; identical to SEQ ID NO: 2259
  Description of Artificial Sequence: Synthetic oligonucleotide

SEQ ID NO: 2434 - DNA, 102 bp, Artificial Sequence; identical to SEQ ID NO: 2260
  Description of Artificial Sequence: Synthetic polynucleotide

SEQ ID NO: 2435 - DNA, 102 bp, Artificial Sequence; identical to SEQ ID NO: 2261
  Description of Artificial Sequence: Synthetic polynucleotide

SEQ ID NO: 2436 - DNA, 108 bp, Artificial Sequence; identical to SEQ ID NO: 2262
  Description of Artificial Sequence: Synthetic polynucleotide

SEQ ID NO: 2437 - DNA, 108 bp, Artificial Sequence; identical to SEQ ID NO: 2262
  Description of Artificial Sequence: Synthetic polynucleotide

SEQ ID NO: 2438 - DNA, 45 bp, Artificial Sequence; identical to SEQ ID NO: 2264
  Description of Artificial Sequence: Synthetic oligonucleotide

SEQ ID NO: 2439 - DNA, 27 bp, Artificial Sequence
  Description of Artificial Sequence: Synthetic oligonucleotide
ggccgcagcattcatgaaattccgcgc

SEQ ID NO: 2440 - DNA, 63 bp, Artificial Sequence; identical to SEQ ID NO: 2266
  Description of Artificial Sequence: Synthetic oligonucleotide

SEQ ID NO: 2441 - DNA, 36 bp, Artificial Sequence; identical to SEQ ID NO: 2267
  Description of Artificial Sequence: Synthetic oligonucleotide

SEQ ID NO: 2442 - DNA, 39 bp, Artificial Sequence; identical to SEQ ID NO: 2268
  Description of Artificial Sequence: Synthetic oligonucleotide

SEQ ID NO: 2443 - DNA, 60 bp, Artificial Sequence; identical to SEQ ID NO: 2269
  Description of Artificial Sequence: Synthetic oligonucleotide

SEQ ID NO: 2444 - DNA, 39 bp, Artificial Sequence; identical to SEQ ID NO: 2270
  Description of Artificial Sequence: Synthetic oligonucleotide

SEQ ID NO: 2445 - DNA, 51 bp, Artificial Sequence; identical to SEQ ID NO: 2271
  Description of Artificial Sequence: Synthetic oligonucleotide

SEQ ID NO: 2446 - DNA, 84 bp, Artificial Sequence; identical to SEQ ID NO: 2272
  Description of Artificial Sequence: Synthetic oligonucleotide

SEQ ID NO: 2447 - DNA, 33 bp, Artificial Sequence; identical to SEQ ID NO: 2273
  Description of Artificial Sequence: Synthetic oligonucleotide

SEQ ID NO: 2448 - DNA, 48 bp, Artificial Sequence; identical to SEQ ID NO: 2274
  Description of Artificial Sequence: Synthetic oligonucleotide

SEQ ID NO: 2449 - DNA, 39 bp, Artificial Sequence; identical to SEQ ID NO: 2275
  Description of Artificial Sequence: Synthetic oligonucleotide

SEQ ID NO: 2450 - DNA, 24 bp, Artificial Sequence
  Description of Artificial Sequence: Synthetic oligonucleotide
tatcgcgatcgccgccgcccgagc

SEQ ID NO: 2451 - DNA, 39 bp, Artificial Sequence; identical to SEQ ID NO: 2277
  Description of Artificial Sequence: Synthetic oligonucleotide

SEQ ID NO: 2452 - DNA, 27 bp, Artificial Sequence
  Description of Artificial Sequence: Synthetic oligonucleotide
cagcagtggagcagccatatttttacc

SEQ ID NO: 2453 - DNA, 42 bp, Artificial Sequence; identical to SEQ ID NO: 2279
  Description of Artificial Sequence: Synthetic oligonucleotide

SEQ ID NO: 2454 - DNA, 27 bp, Artificial Sequence
  Description of Artificial Sequence: Synthetic oligonucleotide
cagaacggccatagctttccgtttacc

SEQ ID NO: 2455 - DNA, 30 bp, Artificial Sequence; identical to SEQ ID NO: 2281
  Description of Artificial Sequence: Synthetic oligonucleotide

SEQ ID NO: 2456 - DNA, 24 bp, Artificial Sequence
  Description of Artificial Sequence: Synthetic oligonucleotide
gcgcgcaactgggatgtggcgtat

SEQ ID NO: 2457 - DNA, 33 bp, Artificial Sequence; identical to SEQ ID NO: 2283
  Description of Artificial Sequence: Synthetic oligonucleotide

SEQ ID NO: 2458 - DNA, 30 bp, Artificial Sequence; identical to SEQ ID NO: 2284
  Description of Artificial Sequence: Synthetic oligonucleotide

SEQ ID NO: 2459 - DNA, 42 bp, Artificial Sequence; identical to SEQ ID NO: 2285
  Description of Artificial Sequence: Synthetic oligonucleotide

SEQ ID NO: 2460 - DNA, 30 bp, Artificial Sequence; identical to SEQ ID NO: 2286
  Description of Artificial Sequence: Synthetic oligonucleotide

SEQ ID NO: 2461 - DNA, 27 bp, Artificial Sequence
  Description of Artificial Sequence: Synthetic oligonucleotide
ctgatttatccgtataacggctttaac

SEQ ID NO: 2462 - DNA, 39 bp, Artificial Sequence; identical to SEQ ID NO: 2288
  Description of Artificial Sequence: Synthetic oligonucleotide

SEQ ID NO: 2463 - DNA, 45 bp, Artificial Sequence; identical to SEQ ID NO: 2289
  Description of Artificial Sequence: Synthetic oligonucleotide

SEQ ID NO: 2464 - DNA, 27 bp, Artificial Sequence
  Description of Artificial Sequence: Synthetic oligonucleotide
agccgcgattatggctattattttgat

SEQ ID NO: 2465 - DNA, 30 bp, Artificial Sequence; identical to SEQ ID NO: 2291
  Description of Artificial Sequence: Synthetic oligonucleotide

SEQ ID NO: 2466 - DNA, 24 bp, Artificial Sequence
  Description of Artificial Sequence: Synthetic oligonucleotide
cagtggtggtggtggccgagcacc

SEQ ID NO: 2467 - DNA, 36 bp, Artificial Sequence; identical to SEQ ID NO: 2293
  Description of Artificial Sequence: Synthetic oligonucleotide

SEQ ID NO: 2468 - DNA, 24 bp, Artificial Sequence
  Description of Artificial Sequence: Synthetic oligonucleotide
tatgataacaaccagcgcccgagc

SEQ ID NO: 2469 - DNA, 51 bp, Artificial Sequence; identical to SEQ ID NO: 2295
  Description of Artificial Sequence: Synthetic oligonucleotide

SEQ ID NO: 2470 - DNA, 36 bp, Artificial Sequence; identical to SEQ ID NO: 2296
  Description of Artificial Sequence: Synthetic oligonucleotide

SEQ ID NO: 2471 - DNA, 27 bp, Artificial Sequence
  Description of Artificial Sequence: Synthetic oligonucleotide
acccgccatgatggcaccaactttgat

SEQ ID NO: 2472 - DNA, 27 bp, Artificial Sequence
  Description of Artificial Sequence: Synthetic oligonucleotide
cagcaggcgaaagcgtttccgccgacc

SEQ ID NO: 2473 - DNA, 36 bp, Artificial Sequence; identical to SEQ ID NO: 2299
  Description of Artificial Sequence: Synthetic oligonucleotide

SEQ ID NO: 2474 - DNA, 24 bp, Artificial Sequence
  Description of Artificial Sequence: Synthetic oligonucleotide
tggattaacaccgaaaccggcagc

SEQ ID NO: 2475 - DNA, 24 bp, Artificial Sequence
  Description of Artificial Sequence: Synthetic oligonucleotide
tggattaacacctataccggcgaa

SEQ ID NO: 2476 - DNA, 30 bp, Artificial Sequence; identical to SEQ ID NO: 2302
  Description of Artificial Sequence: Synthetic oligonucleotide

SEQ ID NO: 2477 - DNA, 33 bp, Artificial Sequence; identical to SEQ ID NO: 2245
  Description of Artificial Sequence: Synthetic oligonucleotide

SEQ ID NO: 2478 - DNA, 24 bp, Artificial Sequence
  Description of Artificial Sequence: Synthetic oligonucleotide
ctgagccgccgcccggattatcgc

SEQ ID NO: 2479 - DNA, 42 bp, Artificial Sequence; identical to SEQ ID NO: 2247
  Description of Artificial Sequence: Synthetic oligonucleotide

SEQ ID NO: 2480 - DNA, 78 bp, Artificial Sequence; identical to SEQ ID NO: 2248
  Description of Artificial Sequence: Synthetic oligonucleotide

SEQ ID NO: 2481 - DNA, 57 bp, Artificial Sequence; identical to SEQ ID NO: 65
  Description of Artificial Sequence: Synthetic oligonucleotide

SEQ ID NO: 2482 - DNA, 66 bp, Artificial Sequence; identical to SEQ ID NO: 67
  Description of Artificial Sequence: Synthetic oligonucleotide

SEQ ID NO: 2483 - DNA, 57 bp, Artificial Sequence; identical to SEQ ID NO: 69
  Description of Artificial Sequence: Synthetic oligonucleotide

SEQ ID NO: 2484 - DNA, 48 bp, Artificial Sequence; identical to SEQ ID NO: 71
  Description of Artificial Sequence: Synthetic oligonucleotide

SEQ ID NO: 2485 - DNA, 42 bp, Artificial Sequence; identical to SEQ ID NO: 73
  Description of Artificial Sequence: Synthetic oligonucleotide

SEQ ID NO: 2486 - DNA, 48 bp, Artificial Sequence; identical to SEQ ID NO: 75
  Description of Artificial Sequence: Synthetic oligonucleotide

SEQ ID NO: 2487 - DNA, 93 bp, Artificial Sequence; identical to SEQ ID NO: 2136
  Description of Artificial Sequence: Synthetic oligonucleotide

SEQ ID NO: 2488 - DNA, 60 bp, Artificial Sequence; identical to SEQ ID NO: 2137
  Description of Artificial Sequence: Synthetic oligonucleotide

SEQ ID NO: 2489 - DNA, 171 bp, Artificial Sequence; identical to SEQ ID NO: 2138
  Description of Artificial Sequence: Synthetic polynucleotide

SEQ ID NO: 2490 - DNA, 27 bp, Artificial Sequence
  Description of Artificial Sequence: Synthetic oligonucleotide
  modified_base (4)..(9): n is a, c, g, or t
gatnnnnnngaatttgatcagtatctg

SEQ ID NO: 2491 - DNA, 99 bp, Artificial Sequence; identical to SEQ ID NO: 2140
  Description of Artificial Sequence: Synthetic oligonucleotide

SEQ ID NO: 2492 - DNA, 45 bp, Artificial Sequence; identical to SEQ ID NO: 77
  Description of Artificial Sequence: Synthetic oligonucleotide

SEQ ID NO: 2493 - DNA, 18 bp, Artificial Sequence
  Description of Artificial Sequence: Synthetic oligonucleotide
cccctgtacatcagctac

SEQ ID NO: 2494 - DNA, 57 bp, Artificial Sequence; identical to SEQ ID NO: 2143
  Description of Artificial Sequence: Synthetic oligonucleotide

SEQ ID NO: 2495 - DNA, 60 bp, Artificial Sequence; identical to SEQ ID NO: 2144
  Description of Artificial Sequence: Synthetic oligonucleotide

SEQ ID NO: 2496 - DNA, 66 bp, Artificial Sequence; identical to SEQ ID NO: 2145
  Description of Artificial Sequence: Synthetic oligonucleotide

SEQ ID NO: 2497 - DNA, 36 bp, Artificial Sequence; identical to SEQ ID NO: 2146
  Description of Artificial Sequence: Synthetic oligonucleotide

SEQ ID NO: 2498 - DNA, 33 bp, Artificial Sequence; identical to SEQ ID NO: 2147
  Description of Artificial Sequence: Synthetic oligonucleotide

SEQ ID NO: 2499 - DNA, 30 bp, Artificial Sequence; identical to SEQ ID NO: 2148
  Description of Artificial Sequence: Synthetic oligonucleotide

SEQ ID NO: 2500 - DNA, 30 bp, Artificial Sequence; identical to SEQ ID NO: 2149
  Description of Artificial Sequence: Synthetic oligonucleotide
  modified_base (13)..(18): n is a, c, g, or t
  modified_base (25)..(30): n is a, c, g, or t

SEQ ID NO: 2501 - DNA, 24 bp, Artificial Sequence
  Description of Artificial Sequence: Synthetic oligonucleotide
agcattgtgtttggcgcgcatgat

SEQ ID NO: 2502 - DNA, 27 bp, Artificial Sequence
  Description of Artificial Sequence: Synthetic oligonucleotide
tatggccatggccaggtgtattattat

SEQ ID NO: 2503 - DNA, 18 bp, Artificial Sequence
  Description of Artificial Sequence: Synthetic oligonucleotide
gaaaacccgaaacagaac

SEQ ID NO: 2504 - DNA, 36 bp, Artificial Sequence; identical to SEQ ID NO: 2153
  Description of Artificial Sequence: Synthetic oligonucleotide

SEQ ID NO: 2505 - DNA, 21 bp, Artificial Sequence
  Description of Artificial Sequence: Synthetic oligonucleotide
aaatcccgcgatttctatcat

SEQ ID NO: 2506 - DNA, 48 bp, Artificial Sequence; identical to SEQ ID NO: 2155
  Description of Artificial Sequence: Synthetic oligonucleotide

SEQ ID NO: 2507 - DNA, 75 bp, Artificial Sequence; identical to SEQ ID NO: 2156
  Description of Artificial Sequence: Synthetic oligonucleotide

SEQ ID NO: 2508 - DNA, 18 bp, Artificial Sequence
  Description of Artificial Sequence: Synthetic oligonucleotide
acctatcaggaaacctat

SEQ ID NO: 2509 - DNA, 96 bp, Artificial Sequence; identical to SEQ ID NO: 2158
  Description of Artificial Sequence: Synthetic oligonucleotide

SEQ ID NO: 2510 - DNA, 42 bp, Artificial Sequence; identical to SEQ ID NO: 2159
  Description of Artificial Sequence: Synthetic oligonucleotide

SEQ ID NO: 2511 - DNA, 42 bp, Artificial Sequence; identical to SEQ ID NO: 2160
  Description of Artificial Sequence: Synthetic oligonucleotide

SEQ ID NO: 2512 - DNA, 87 bp, Artificial Sequence; identical to SEQ ID NO: 2161
  Description of Artificial Sequence: Synthetic oligonucleotide

SEQ ID NO: 2513 - DNA, 33 bp, Artificial Sequence; identical to SEQ ID NO: 2162
  Description of Artificial Sequence: Synthetic oligonucleotide

SEQ ID NO: 2514 - DNA, 33 bp, Artificial Sequence; identical to SEQ ID NO: 2163
  Description of Artificial Sequence: Synthetic oligonucleotide

SEQ ID NO: 2515 - DNA, 51 bp, Artificial Sequence; identical to SEQ ID NO: 2164
  Description of Artificial Sequence: Synthetic oligonucleotide

SEQ ID NO: 2516 - DNA, 27 bp, Artificial Sequence
  Description of Artificial Sequence: Synthetic oligonucleotide
cagcatgattataccgcgaccgatgaa

SEQ ID NO: 2517 - DNA, 30 bp, Artificial Sequence; identical to SEQ ID NO: 2166
  Description of Artificial Sequence: Synthetic oligonucleotide

SEQ ID NO: 2518 - DNA, 33 bp, Artificial Sequence; identical to SEQ ID NO: 2167
  Description of Artificial Sequence: Synthetic oligonucleotide

SEQ ID NO: 2519 - DNA, 39 bp, Artificial Sequence; identical to SEQ ID NO: 2206
  Description of Artificial Sequence: Synthetic oligonucleotide

SEQ ID NO: 2520 - DNA, 51 bp, Artificial Sequence; identical to SEQ ID NO: 2207
  Description of Artificial Sequence: Synthetic oligonucleotide

SEQ ID NO: 2521 - DNA, 36 bp, Artificial Sequence; identical to SEQ ID NO: 2208
  Description of Artificial Sequence: Synthetic oligonucleotide

SEQ ID NO: 2522 - DNA, 45 bp, Artificial Sequence; identical to SEQ ID NO: 2209
  Description of Artificial Sequence: Synthetic oligonucleotide

SEQ ID NO: 2523 - DNA, 111 bp, Artificial Sequence; identical to SEQ ID NO: 2210
  Description of Artificial Sequence: Synthetic polynucleotide

SEQ ID NO: 2524 - DNA, 75 bp, Artificial Sequence; identical to SEQ ID NO: 2211
  Description of Artificial Sequence: Synthetic oligonucleotide

SEQ ID NO: 2525 - DNA, 93 bp, Artificial Sequence; identical to SEQ ID NO: 2212
  Description of Artificial Sequence: Synthetic oligonucleotide

SEQ ID NO: 2526 - DNA, 87 bp, Artificial Sequence; identical to SEQ ID NO: 2213
  Description of Artificial Sequence: Synthetic oligonucleotide

SEQ ID NO: 2527 - DNA, 45 bp, Artificial Sequence; identical to SEQ ID NO: 2214
  Description of Artificial Sequence: Synthetic oligonucleotide

SEQ ID NO: 2528 - DNA, 57 bp, Artificial Sequence; identical to SEQ ID NO: 2215
  Description of Artificial Sequence: Synthetic oligonucleotide

SEQ ID NO: 2529 - DNA, 60 bp, Artificial Sequence; identical to SEQ ID NO: 2216
  Description of Artificial Sequence: Synthetic oligonucleotide

SEQ ID NO: 2530 - DNA, 60 bp, Artificial Sequence; identical to SEQ ID NO: 2217
  Description of Artificial Sequence: Synthetic oligonucleotide

SEQ ID NO: 2531 - DNA, 60 bp, Artificial Sequence; identical to SEQ ID NO: 2218
  Description of Artificial Sequence: Synthetic oligonucleotide

SEQ ID NO: 2532 - DNA, 60 bp, Artificial Sequence; identical to SEQ ID NO: 2219
  Description of Artificial Sequence: Synthetic oligonucleotide

SEQ ID NO: 2533 - DNA, 15 bp, Artificial Sequence
  Description of Artificial Sequence: Synthetic oligonucleotide
accgcggcgctgagc

SEQ ID NO: 2534 - DNA, 15 bp, Artificial Sequence
  Description of Artificial Sequence: Synthetic oligonucleotide
accgcgctgctgagc

SEQ ID NO: 2535 - DNA, 15 bp, Artificial Sequence
  Description of Artificial Sequence: Synthetic oligonucleotide
ctggcggcgctgagc

SEQ ID NO: 2536 - DNA, 15 bp, Artificial Sequence
  Description of Artificial Sequence: Synthetic oligonucleotide
gatgcggcgctgacc

SEQ ID NO: 2537 - DNA, 15 bp, Artificial Sequence
  Description of Artificial Sequence: Synthetic oligonucleotide
tatgcggcgctgcag

SEQ ID NO: 2538 - DNA, 33 bp, Artificial Sequence; identical to SEQ ID NO: 2225
  Description of Artificial Sequence: Synthetic oligonucleotide
  modified_base (10)..(12): n is a, c, g, or t

SEQ ID NO: 2539 - DNA, 24 bp, Artificial Sequence
  Description of Artificial Sequence: Synthetic oligonucleotide
ccggtgaaacgccgcctgtttctg

SEQ ID NO: 2540 - DNA, 78 bp, Artificial Sequence; identical to SEQ ID NO: 2227
  Description of Artificial Sequence: Synthetic oligonucleotide

SEQ ID NO: 2541 - DNA, 48 bp, Artificial Sequence; identical to SEQ ID NO: 2228
  Description of Artificial Sequence: Synthetic oligonucleotide

SEQ ID NO: 2542 - DNA, 27 bp, Artificial Sequence
  Description of Artificial Sequence: Synthetic oligonucleotide
tttgatccgccgctgcatagcaccgcg

SEQ ID NO: 2543 - DNA, 21 bp, Artificial Sequence
  Description of Artificial Sequence: Synthetic oligonucleotide
ccgctgcatagcaccgcgatt

SEQ ID NO: 2544 - DNA, 18 bp, Artificial Sequence
  Description of Artificial Sequence: Synthetic oligonucleotide
atggatagcaccccgctg

SEQ ID NO: 2545 - DNA, 24 bp, Artificial Sequence
  Description of Artificial Sequence: Synthetic oligonucleotide
tttagccagcataaaaccagcatt

SEQ ID NO: 2546 - DNA, 33 bp, Artificial Sequence; identical to SEQ ID NO: 2233
  Description of Artificial Sequence: Synthetic oligonucleotide

SEQ ID NO: 2547 - DNA, 27 bp, Artificial Sequence
  Description of Artificial Sequence: Synthetic oligonucleotide
ctgctgtgcagcaccccgaacggcctg

SEQ ID NO: 2548 - DNA, 36 bp, Artificial Sequence; identical to SEQ ID NO: 2235
  Description of Artificial Sequence: Synthetic oligonucleotide

SEQ ID NO: 2549 - DNA, 27 bp, Artificial Sequence
  Description of Artificial Sequence: Synthetic oligonucleotide
gcgccgagctatccgccgccgccgccg

SEQ ID NO: 2550 - DNA, 24 bp, Artificial Sequence
  Description of Artificial Sequence: Synthetic oligonucleotide
ctgcagaccattcaggaagaagaa

SEQ ID NO: 2551 - DNA, 12 bp, Artificial Sequence
  Description of Artificial Sequence: Synthetic oligonucleotide
  modified_base (7)..(9): n is a, c, g, or t
cgcgtgnnnttt

SEQ ID NO: 2552 - DNA, 12 bp, Artificial Sequence
  Description of Artificial Sequence: Synthetic oligonucleotide
agcattctgaaa

SEQ ID NO: 2553 - DNA, 45 bp, Artificial Sequence; identical to SEQ ID NO: 2240
  Description of Artificial Sequence: Synthetic oligonucleotide

SEQ ID NO: 2554 - DNA, 81 bp, Artificial Sequence; identical to SEQ ID NO: 2241
  Description of Artificial Sequence: Synthetic oligonucleotide

SEQ ID NO: 2555 - DNA, 63 bp, Artificial Sequence; identical to SEQ ID NO: 2242
  Description of Artificial Sequence: Synthetic oligonucleotide

SEQ ID NO: 2556 - DNA, 75 bp, Artificial Sequence; identical to SEQ ID NO: 2243
  Description of Artificial Sequence: Synthetic oligonucleotide

SEQ ID NO: 2557 - DNA, 63 bp, Artificial Sequence; identical to SEQ ID NO: 2244
  Description of Artificial Sequence: Synthetic oligonucleotide
  modified_base (22)..(24): n is a, c, g, or t
  modified_base (34)..(36): n is a, c, g, or t

SEQ ID NO: 2558 - DNA, 33 bp, Artificial Sequence; identical to SEQ ID NO: 2245
  Description of Artificial Sequence: Synthetic oligonucleotide

SEQ ID NO: 2559 - DNA, 24 bp, Artificial Sequence
  Description of Artificial Sequence: Synthetic oligonucleotide
ctgagccgccgcccggattatcgc

SEQ ID NO: 2560 - DNA, 42 bp, Artificial Sequence; identical to SEQ ID NO: 2247
  Description of Artificial Sequence: Synthetic oligonucleotide

SEQ ID NO: 2561 - DNA, 78 bp, Artificial Sequence; identical to SEQ ID NO: 2248
  Description of Artificial Sequence: Synthetic oligonucleotide

SEQ ID NO: 2562 - DNA, 27 bp, Artificial Sequence
  Description of Artificial Sequence: Synthetic oligonucleotide
agcggctggaccgtggtgcgcatgtat

SEQ ID NO: 2563 - DNA, 24 bp, Artificial Sequence
  Description of Artificial Sequence: Synthetic oligonucleotide
cgtgaagccggtgatggtgaagaa

SEQ ID NO: 2564 - DNA, 42 bp, Artificial Sequence; identical to SEQ ID NO: 81
  Description of Artificial Sequence: Synthetic oligonucleotide

SEQ ID NO: 2565 - DNA, 63 bp, Artificial Sequence; identical to SEQ ID NO: 2252
  Description of Artificial Sequence: Synthetic oligonucleotide

SEQ ID NO: 2566 - DNA, 48 bp, Artificial Sequence; identical to SEQ ID NO: 2253
  Description of Artificial Sequence: Synthetic oligonucleotide

SEQ ID NO: 2567 - DNA, 75 bp, Artificial Sequence; identical to SEQ ID NO: 2254
  Description of Artificial Sequence: Synthetic oligonucleotide

SEQ ID NO: 2568 - DNA, 126 bp, Artificial Sequence; identical to SEQ ID NO: 2255
  Description of Artificial Sequence: Synthetic polynucleotide

SEQ ID NO: 2569 - DNA, 96 bp, Artificial Sequence; identical to SEQ ID NO: 2256
  Description of Artificial Sequence: Synthetic oligonucleotide

SEQ ID NO: 2570 - DNA, 45 bp, Artificial Sequence; identical to SEQ ID NO: 2257
  Description of Artificial Sequence: Synthetic oligonucleotide

SEQ ID NO: 2571 - DNA, 60 bp, Artificial Sequence; identical to SEQ ID NO: 2258
  Description of Artificial Sequence: Synthetic oligonucleotide

SEQ ID NO: 2572 - DNA, 42 bp, Artificial Sequence; identical to SEQ ID NO: 2259
  Description of Artificial Sequence: Synthetic oligonucleotide

SEQ ID NO: 2573 - DNA, 102 bp, Artificial Sequence; identical to SEQ ID NO: 2260
  Description of Artificial Sequence: Synthetic polynucleotide

SEQ ID NO: 2574 - DNA, 102 bp, Artificial Sequence; identical to SEQ ID NO: 2261
  Description of Artificial Sequence: Synthetic polynucleotide

SEQ ID NO: 2575 - DNA, 108 bp, Artificial Sequence; identical to SEQ ID NO: 2262
  Description of Artificial Sequence: Synthetic polynucleotide

SEQ ID NO: 2576 - DNA, 108 bp, Artificial Sequence; identical to SEQ ID NO: 2262
  Description of Artificial Sequence: Synthetic polynucleotide

SEQ ID NO: 2577 - DNA, 45 bp, Artificial Sequence; identical to SEQ ID NO: 2264
  Description of Artificial Sequence: Synthetic oligonucleotide

SEQ ID NO: 2578 - DNA, 27 bp, Artificial Sequence
  Description of Artificial Sequence: Synthetic oligonucleotide
ggccgcagcattcatgaaattccgcgc

SEQ ID NO: 2579 - DNA, 63 bp, Artificial Sequence; identical to SEQ ID NO: 2266
  Description of Artificial Sequence: Synthetic oligonucleotide

SEQ ID NO: 2580 - DNA, 36 bp, Artificial Sequence; identical to SEQ ID NO: 2267
  Description of Artificial Sequence: Synthetic oligonucleotide

SEQ ID NO: 2581 - DNA, 39 bp, Artificial Sequence; identical to SEQ ID NO: 2268
  Description of Artificial Sequence: Synthetic oligonucleotide

SEQ ID NO: 2582 - DNA, 60 bp, Artificial Sequence; identical to SEQ ID NO: 2269
  Description of Artificial Sequence: Synthetic oligonucleotide

SEQ ID NO: 2583 - DNA, 39 bp, Artificial Sequence; identical to SEQ ID NO: 2270
  Description of Artificial Sequence: Synthetic oligonucleotide

SEQ ID NO: 2584 - DNA, 51 bp, Artificial Sequence; identical to SEQ ID NO: 2271
  Description of Artificial Sequence: Synthetic oligonucleotide

SEQ ID NO: 2585 - DNA, 84 bp, Artificial Sequence; identical to SEQ ID NO: 2272
  Description of Artificial Sequence: Synthetic oligonucleotide

SEQ ID NO: 2586 - DNA, 33 bp, Artificial Sequence; identical to SEQ ID NO: 2273
  Description of Artificial Sequence: Synthetic oligonucleotide

SEQ ID NO: 2587 - DNA, 48 bp, Artificial Sequence; identical to SEQ ID NO: 2274
  Description of Artificial Sequence: Synthetic oligonucleotide

SEQ ID NO: 2588 - DNA, 39 bp, Artificial Sequence; identical to SEQ ID NO: 2275
  Description of Artificial Sequence: Synthetic oligonucleotide

SEQ ID NO: 2589 - DNA, 24 bp, Artificial Sequence
  Description of Artificial Sequence: Synthetic oligonucleotide
tatcgcgatcgccgccgcccgagc

SEQ ID NO: 2590 - DNA, 39 bp, Artificial Sequence; identical to SEQ ID NO: 2277
  Description of Artificial Sequence: Synthetic oligonucleotide

SEQ ID NO: 2591 - DNA, 27 bp, Artificial Sequence
  Description of Artificial Sequence: Synthetic oligonucleotide
cagcagtggagcagccatatttttacc

SEQ ID NO: 2592 - DNA, 42 bp, Artificial Sequence; identical to SEQ ID NO: 2279
  Description of Artificial Sequence: Synthetic oligonucleotide

SEQ ID NO: 2593 - DNA, 27 bp, Artificial Sequence
  Description of Artificial Sequence: Synthetic oligonucleotide
cagaacggccatagctttccgtttacc

SEQ ID NO: 2594 - DNA, 30 bp, Artificial Sequence; identical to SEQ ID NO: 2281
  Description of Artificial Sequence: Synthetic oligonucleotide

SEQ ID NO: 2595 - DNA, 24 bp, Artificial Sequence
  Description of Artificial Sequence: Synthetic oligonucleotide
gcgcgcaactgggatgtggcgtat

SEQ ID NO: 2596 - DNA, 33 bp, Artificial Sequence; identical to SEQ ID NO: 2283
  Description of Artificial Sequence: Synthetic oligonucleotide

SEQ ID NO: 2597 - DNA, 30 bp, Artificial Sequence; identical to SEQ ID NO: 2284
  Description of Artificial Sequence: Synthetic oligonucleotide

SEQ ID NO: 2598 - DNA, 42 bp, Artificial Sequence; identical to SEQ ID NO: 2285
  Description of Artificial Sequence: Synthetic oligonucleotide

SEQ ID NO: 2599 - DNA, 30 bp, Artificial Sequence; identical to SEQ ID NO: 2286
  Description of Artificial Sequence: Synthetic oligonucleotide

SEQ ID NO: 2600 - DNA, 27 bp, Artificial Sequence
  Description of Artificial Sequence: Synthetic oligonucleotide
ctgatttatccgtataacggctttaac

SEQ ID NO: 2601 - DNA, 39 bp, Artificial Sequence; identical to SEQ ID NO: 2288
  Description of Artificial Sequence: Synthetic oligonucleotide

SEQ ID NO: 2602 - DNA, 45 bp, Artificial Sequence; identical to SEQ ID NO: 2289
  Description of Artificial Sequence: Synthetic oligonucleotide

SEQ ID NO: 2603 - DNA, 27 bp, Artificial Sequence
  Description of Artificial Sequence: Synthetic oligonucleotide
agccgcgattatggctattattttgat

SEQ ID NO: 2604 - DNA, 30 bp, Artificial Sequence; identical to SEQ ID NO: 2291
  Description of Artificial Sequence: Synthetic oligonucleotide

SEQ ID NO: 2605 - DNA, 24 bp, Artificial Sequence
  Description of Artificial Sequence: Synthetic oligonucleotide
cagtggtggtggtggccgagcacc

SEQ ID NO: 2606 - DNA, 36 bp, Artificial Sequence; identical to SEQ ID NO: 2293
  Description of Artificial Sequence: Synthetic oligonucleotide

SEQ ID NO: 2607 - DNA, 24 bp, Artificial Sequence
  Description of Artificial Sequence: Synthetic oligonucleotide
tatgataacaaccagcgcccgagc

SEQ ID NO: 2608 - DNA, 51 bp, Artificial Sequence; identical to SEQ ID NO: 2295
  Description of Artificial Sequence: Synthetic oligonucleotide

SEQ ID NO: 2609 - DNA, 36 bp, Artificial Sequence; identical to SEQ ID NO: 2296
  Description of Artificial Sequence: Synthetic oligonucleotide

SEQ ID NO: 2610 - DNA, 27 bp, Artificial Sequence
  Description of Artificial Sequence: Synthetic oligonucleotide
acccgccatgatggcaccaactttgat

SEQ ID NO: 2611 - DNA, 27 bp, Artificial Sequence
  Description of Artificial Sequence: Synthetic oligonucleotide
cagcaggcgaaagcgtttccgccgacc

SEQ ID NO: 2612 - DNA, 36 bp, Artificial Sequence; identical to SEQ ID NO: 2299
  Description of Artificial Sequence: Synthetic oligonucleotide

SEQ ID NO: 2613 - DNA, 24 bp, Artificial Sequence
  Description of Artificial Sequence: Synthetic oligonucleotide
tggattaacaccgaaaccggcagc

SEQ ID NO: 2614 - DNA, 24 bp, Artificial Sequence
  Description of Artificial Sequence: Synthetic oligonucleotide
tggattaacacctataccggcgaa

SEQ ID NO: 2615 - DNA, 30 bp, Artificial Sequence; identical to SEQ ID NO: 2302
  Description of Artificial Sequence: Synthetic oligonucleotide

SEQ ID NO: 2616 - DNA, 27 bp, Artificial Sequence
  Description of Artificial Sequence: Synthetic oligonucleotide
agcggctggaccgtggtgcgcatgtat

SEQ ID NO: 2617 - DNA, 24 bp, Artificial Sequence
  Description of Artificial Sequence: Synthetic oligonucleotide
cgtgaagccggtgatggtgaagaa

SEQ ID NO: 2618 - DNA, 42 bp, Artificial Sequence; identical to SEQ ID NO: 81
  Description of Artificial Sequence: Synthetic oligonucleotide

SEQ ID NO: 2619 - DNA, 57 bp, Artificial Sequence; identical to SEQ ID NO: 65
  Description of Artificial Sequence: Synthetic oligonucleotide

SEQ ID NO: 2620 - DNA, 66 bp, Artificial Sequence; identical to SEQ ID NO: 67
  Description of Artificial Sequence: Synthetic oligonucleotide

SEQ ID NO: 2621 - DNA, 57 bp, Artificial Sequence; identical to SEQ ID NO: 69
  Description of Artificial Sequence: Synthetic oligonucleotide

SEQ ID NO: 2622 - DNA, 48 bp, Artificial Sequence; identical to SEQ ID NO: 71
  Description of Artificial Sequence: Synthetic oligonucleotide

SEQ ID NO: 2623 - DNA, 42 bp, Artificial Sequence; identical to SEQ ID NO: 73
  Description of Artificial Sequence: Synthetic oligonucleotide

SEQ ID NO: 2624 - DNA, 48 bp, Artificial Sequence; identical to SEQ ID NO: 75
  Description of Artificial Sequence: Synthetic oligonucleotide

SEQ ID NO: 2625 - DNA, 93 bp, Artificial Sequence; identical to SEQ ID NO: 2136
  Description of Artificial Sequence: Synthetic oligonucleotide

SEQ ID NO: 2626 - DNA, 60 bp, Artificial Sequence; identical to SEQ ID NO: 2137
  Description of Artificial Sequence: Synthetic oligonucleotide

SEQ ID NO: 2627 - DNA, 171 bp, Artificial Sequence; identical to SEQ ID NO: 2138
  Description of Artificial Sequence: Synthetic polynucleotide

SEQ ID NO: 2628 - DNA, 27 bp, Artificial Sequence
  Description of Artificial Sequence: Synthetic oligonucleotide
  modified_base (4)..(9): n is a, c, g, or t
gatnnnnnngaatttgatcagtatctg

SEQ ID NO: 2629 - DNA, 99 bp, Artificial Sequence; identical to SEQ ID NO: 2140
  Description of Artificial Sequence: Synthetic oligonucleotide

SEQ ID NO: 2630 - DNA, 45 bp, Artificial Sequence; identical to SEQ ID NO: 77
  Description of Artificial Sequence: Synthetic oligonucleotide

SEQ ID NO: 2631 - DNA, 18 bp, Artificial Sequence
  Description of Artificial Sequence: Synthetic oligonucleotide
cccctgtacatcagctac

SEQ ID NO: 2632 - DNA, 57 bp, Artificial Sequence; identical to SEQ ID NO: 2143
  Description of Artificial Sequence: Synthetic oligonucleotide

SEQ ID NO: 2633 - DNA, 60 bp, Artificial Sequence; identical to SEQ ID NO: 2144
  Description of Artificial Sequence: Synthetic oligonucleotide

SEQ ID NO: 2634 - DNA, 66 bp, Artificial Sequence; identical to SEQ ID NO: 2145
  Description of Artificial Sequence: Synthetic oligonucleotide

SEQ ID NO: 2635 - DNA, 36 bp, Artificial Sequence; identical to SEQ ID NO: 2146
  Description of Artificial Sequence: Synthetic oligonucleotide

SEQ ID NO: 2636 - DNA, 33 bp, Artificial Sequence; identical to SEQ ID NO: 2147
  Description of Artificial Sequence: Synthetic oligonucleotide

SEQ ID NO: 2637 - DNA, 30 bp, Artificial Sequence; identical to SEQ ID NO: 2148
  Description of Artificial Sequence: Synthetic oligonucleotide

SEQ ID NO: 2638 - DNA, 30 bp, Artificial Sequence; identical to SEQ ID NO: 2149
  Description of Artificial Sequence: Synthetic oligonucleotide
  modified_base (13)..(18): n is a, c, g, or t
  modified_base (25)..(30): n is a, c, g, or t

SEQ ID NO: 2639 - DNA, 24 bp, Artificial Sequence
  Description of Artificial Sequence: Synthetic oligonucleotide
agcattgtgtttggcgcgcatgat

SEQ ID NO: 2640 - DNA, 27 bp, Artificial Sequence
  Description of Artificial Sequence: Synthetic oligonucleotide
tatggccatggccaggtgtattattat

SEQ ID NO: 2641 - DNA, 18 bp, Artificial Sequence
  Description of Artificial Sequence: Synthetic oligonucleotide
gaaaacccgaaacagaac

SEQ ID NO: 2642 - DNA, 36 bp, Artificial Sequence; identical to SEQ ID NO: 2153
  Description of Artificial Sequence: Synthetic oligonucleotide

SEQ ID NO: 2643 - DNA, 21 bp, Artificial Sequence
  Description of Artificial Sequence: Synthetic oligonucleotide
aaatcccgcgatttctatcat

SEQ ID NO: 2644 - DNA, 48 bp, Artificial Sequence; identical to SEQ ID NO: 2155
  Description of Artificial Sequence: Synthetic oligonucleotide

SEQ ID NO: 2645 - DNA, 75 bp, Artificial Sequence; identical to SEQ ID NO: 2156
  Description of Artificial Sequence: Synthetic oligonucleotide

SEQ ID NO: 2646 - DNA, 18 bp, Artificial Sequence
  Description of Artificial Sequence: Synthetic oligonucleotide
acctatcaggaaacctat

SEQ ID NO: 2647 - DNA, 96 bp, Artificial Sequence; identical to SEQ ID NO: 2158
  Description of Artificial Sequence: Synthetic oligonucleotide

SEQ ID NO: 2648 - DNA, 42 bp, Artificial Sequence; identical to SEQ ID NO: 2159
  Description of Artificial Sequence: Synthetic oligonucleotide

SEQ ID NO: 2649 - DNA, 42 bp, Artificial Sequence; identical to SEQ ID NO: 2160
  Description of Artificial Sequence: Synthetic oligonucleotide

SEQ ID NO: 2650 - DNA, 87 bp, Artificial Sequence; identical to SEQ ID NO: 2161
  Description of Artificial Sequence: Synthetic oligonucleotide

SEQ ID NO: 2651 - DNA, 33 bp, Artificial Sequence; identical to SEQ ID NO: 2162
  Description of Artificial Sequence: Synthetic oligonucleotide

SEQ ID NO: 2652 - DNA, 33 bp, Artificial Sequence; identical to SEQ ID NO: 2163
  Description of Artificial Sequence: Synthetic oligonucleotide

SEQ ID NO: 2653 - DNA, 51 bp, Artificial Sequence; identical to SEQ ID NO: 2164
  Description of Artificial Sequence: Synthetic oligonucleotide

SEQ ID NO: 2654 - DNA, 27 bp, Artificial Sequence
  Description of Artificial Sequence: Synthetic oligonucleotide
cagcatgattataccgcgaccgatgaa

SEQ ID NO: 2655 - DNA, 30 bp, Artificial Sequence; identical to SEQ ID NO: 2166
  Description of Artificial Sequence: Synthetic oligonucleotide

SEQ ID NO: 2656 - DNA, 33 bp, Artificial Sequence; identical to SEQ ID NO: 2167
  Description of Artificial Sequence: Synthetic oligonucleotide

SEQ ID NO: 2657 - DNA, 39 bp, Artificial Sequence; identical to SEQ ID NO: 2206
  Description of Artificial Sequence: Synthetic oligonucleotide

SEQ ID NO: 2658 - DNA, 51 bp, Artificial Sequence; identical to SEQ ID NO: 2207
  Description of Artificial Sequence: Synthetic oligonucleotide

SEQ ID NO: 2659 - DNA, 36 bp, Artificial Sequence; identical to SEQ ID NO: 2208
  Description of Artificial Sequence: Synthetic oligonucleotide

SEQ ID NO: 2660 - DNA, 45 bp, Artificial Sequence; identical to SEQ ID NO: 2209
  Description of Artificial Sequence: Synthetic oligonucleotide

SEQ ID NO: 2661 - DNA, 111 bp, Artificial Sequence; identical to SEQ ID NO: 2210
  Description of Artificial Sequence: Synthetic polynucleotide

SEQ ID NO: 2662 - DNA, 75 bp, Artificial Sequence; identical to SEQ ID NO: 2211
  Description of Artificial Sequence: Synthetic oligonucleotide

SEQ ID NO: 2663 - DNA, 93 bp, Artificial Sequence; identical to SEQ ID NO: 2212
  Description of Artificial Sequence: Synthetic oligonucleotide

SEQ ID NO: 2664 - DNA, 87 bp, Artificial Sequence; identical to SEQ ID NO: 2213
  Description of Artificial Sequence: Synthetic oligonucleotide

SEQ ID NO: 2665 - DNA, 45 bp, Artificial Sequence; identical to SEQ ID NO: 2214
  Description of Artificial Sequence: Synthetic oligonucleotide

SEQ ID NO: 2666 - DNA, 57 bp, Artificial Sequence; identical to SEQ ID NO: 2215
  Description of Artificial Sequence: Synthetic oligonucleotide

SEQ ID NO: 2667 - DNA, 60 bp, Artificial Sequence; identical to SEQ ID NO: 2216
  Description of Artificial Sequence: Synthetic oligonucleotide

SEQ ID NO: 2668 - DNA, 60 bp, Artificial Sequence; identical to SEQ ID NO: 2217
  Description of Artificial Sequence: Synthetic oligonucleotide

SEQ ID NO: 2669 - DNA, 60 bp, Artificial Sequence; identical to SEQ ID NO: 2218
  Description of Artificial Sequence: Synthetic oligonucleotide

SEQ ID NO: 2670 - DNA, 60 bp, Artificial Sequence; identical to SEQ ID NO: 2219
  Description of Artificial Sequence: Synthetic oligonucleotide

SEQ ID NO: 2671 - DNA, 15 bp, Artificial Sequence
  Description of Artificial Sequence: Synthetic oligonucleotide
accgcggcgctgagc

SEQ ID NO: 2672 - DNA, 15 bp, Artificial Sequence
  Description of Artificial Sequence: Synthetic oligonucleotide
accgcgctgctgagc

SEQ ID NO: 2673 - DNA, 15 bp, Artificial Sequence
  Description of Artificial Sequence: Synthetic oligonucleotide
ctggcggcgctgagc

SEQ ID NO: 2674 - DNA, 15 bp, Artificial Sequence
  Description of Artificial Sequence: Synthetic oligonucleotide
gatgcggcgctgacc

SEQ ID NO: 2675 - DNA, 15 bp, Artificial Sequence
  Description of Artificial Sequence: Synthetic oligonucleotide
tatgcggcgctgcag

SEQ ID NO: 2676 - DNA, 33 bp, Artificial Sequence; identical to SEQ ID NO: 2225
  Description of Artificial Sequence: Synthetic oligonucleotide
  modified_base (10)..(12): n is a, c, g, or t

SEQ ID NO: 2677 - DNA, 24 bp, Artificial Sequence
  Description of Artificial Sequence: Synthetic oligonucleotide
ccggtgaaacgccgcctgtttctg

SEQ ID NO: 2678 - DNA, 78 bp, Artificial Sequence; identical to SEQ ID NO: 2227
  Description of Artificial Sequence: Synthetic oligonucleotide

SEQ ID NO: 2679 - DNA, 48 bp, Artificial Sequence; identical to SEQ ID NO: 2228
  Description of Artificial Sequence: Synthetic oligonucleotide

SEQ ID NO: 2680 - DNA, 27 bp, Artificial Sequence
  Description of Artificial Sequence: Synthetic oligonucleotide
tttgatccgccgctgcatagcaccgcg

SEQ ID NO: 2681 - DNA, 21 bp, Artificial Sequence
  Description of Artificial Sequence: Synthetic oligonucleotide
ccgctgcatagcaccgcgatt

SEQ ID NO: 2682 - DNA, 18 bp, Artificial Sequence
  Description of Artificial Sequence: Synthetic oligonucleotide
atggatagcaccccgctg

SEQ ID NO: 2683 - DNA, 24 bp, Artificial Sequence
  Description of Artificial Sequence: Synthetic oligonucleotide
tttagccagcataaaaccagcatt

SEQ ID NO: 2684 - DNA, 33 bp, Artificial Sequence; identical to SEQ ID NO: 2233
  Description of Artificial Sequence: Synthetic oligonucleotide

SEQ ID NO: 2685 - DNA, 27 bp, Artificial Sequence
  Description of Artificial Sequence: Synthetic oligonucleotide
ctgctgtgcagcaccccgaacggcctg

SEQ ID NO: 2686 - DNA, 36 bp, Artificial Sequence; identical to SEQ ID NO: 2235
  Description of Artificial Sequence: Synthetic oligonucleotide

SEQ ID NO: 2687 - DNA, 27 bp, Artificial Sequence
  Description of Artificial Sequence: Synthetic oligonucleotide
gcgccgagctatccgccgccgccgccg

SEQ ID NO: 2688 - DNA, 24 bp, Artificial Sequence
  Description of Artificial Sequence: Synthetic oligonucleotide
ctgcagaccattcaggaagaagaa

SEQ ID NO: 2689 - DNA, 12 bp, Artificial Sequence
  Description of Artificial Sequence: Synthetic oligonucleotide
  modified_base (7)..(9): n is a, c, g, or t
cgcgtgnnnttt

SEQ ID NO: 2690 - DNA, 12 bp, Artificial Sequence
  Description of Artificial Sequence: Synthetic oligonucleotide
agcattctgaaa

SEQ ID NO: 2691 - DNA, 45 bp, Artificial Sequence; identical to SEQ ID NO: 2240
  Description of Artificial Sequence: Synthetic oligonucleotide

SEQ ID NO: 2692 - DNA, 81 bp, Artificial Sequence; identical to SEQ ID NO: 2241
  Description of Artificial Sequence: Synthetic oligonucleotide

SEQ ID NO: 2693 - DNA, 63 bp, Artificial Sequence; identical to SEQ ID NO: 2242
  Description of Artificial Sequence: Synthetic oligonucleotide

SEQ ID NO: 2694 - DNA, 75 bp, Artificial Sequence; identical to SEQ ID NO: 2243
  Description of Artificial Sequence: Synthetic oligonucleotide

SEQ ID NO: 2695 - DNA, 63 bp, Artificial Sequence; identical to SEQ ID NO: 2244
  Description of Artificial Sequence: Synthetic oligonucleotide
  modified_base (22)..(24): n is a, c, g, or t
  modified_base (34)..(36): n is a, c, g, or t

SEQ ID NO: 2696 - DNA, 33 bp, Artificial Sequence; identical to SEQ ID NO: 2245
  Description of Artificial Sequence: Synthetic oligonucleotide

SEQ ID NO: 2697 - DNA, 24 bp, Artificial Sequence
  Description of Artificial Sequence: Synthetic oligonucleotide
ctgagccgccgcccggattatcgc

SEQ ID NO: 2698 - DNA, 42 bp, Artificial Sequence; identical to SEQ ID NO: 2247
  Description of Artificial Sequence: Synthetic oligonucleotide

SEQ ID NO: 2699 - DNA, 78 bp, Artificial Sequence; identical to SEQ ID NO: 2248
  Description of Artificial Sequence: Synthetic oligonucleotide

SEQ ID NO: 2700 - DNA, 27 bp, Artificial Sequence
  Description of Artificial Sequence: Synthetic oligonucleotide
agcggctggaccgtggtgcgcatgtat

SEQ ID NO: 2701 - DNA, 24 bp, Artificial Sequence
  Description of Artificial Sequence: Synthetic oligonucleotide
cgtgaagccggtgatggtgaagaa

SEQ ID NO: 2702 - DNA, 42 bp, Artificial Sequence; identical to SEQ ID NO: 81
  Description of Artificial Sequence: Synthetic oligonucleotide

SEQ ID NO: 2703 - DNA, 63 bp, Artificial Sequence; identical to SEQ ID NO: 2252
  Description of Artificial Sequence: Synthetic oligonucleotide

SEQ ID NO: 2704 - DNA, 48 bp, Artificial Sequence; identical to SEQ ID NO: 2253
  Description of Artificial Sequence: Synthetic oligonucleotide

SEQ ID NO: 2705 - DNA, 75 bp, Artificial Sequence; identical to SEQ ID NO: 2254
  Description of Artificial Sequence: Synthetic oligonucleotide

SEQ ID NO: 2706 - DNA, 126 bp, Artificial Sequence; identical to SEQ ID NO: 2255
  Description of Artificial Sequence: Synthetic polynucleotide

SEQ ID NO: 2707 - DNA, 96 bp, Artificial Sequence; identical to SEQ ID NO: 2256
  Description of Artificial Sequence: Synthetic oligonucleotide

SEQ ID NO: 2708 - DNA, 45 bp, Artificial Sequence; identical to SEQ ID NO: 2257
  Description of Artificial Sequence: Synthetic oligonucleotide

SEQ ID NO: 2709 - DNA, 60 bp, Artificial Sequence; identical to SEQ ID NO: 2258
  Description of Artificial Sequence: Synthetic oligonucleotide

SEQ ID NO: 2710 - DNA, 42 bp, Artificial Sequence; identical to SEQ ID NO: 2259
  Description of Artificial Sequence: Synthetic oligonucleotide

SEQ ID NO: 2711 - DNA, 102 bp, Artificial Sequence; identical to SEQ ID NO: 2260
  Description of Artificial Sequence: Synthetic polynucleotide

SEQ ID NO: 2712 - DNA, 102 bp, Artificial Sequence; identical to SEQ ID NO: 2261
  Description of Artificial Sequence: Synthetic polynucleotide

SEQ ID NO: 2713 - DNA, 108 bp, Artificial Sequence; identical to SEQ ID NO: 2262
  Description of Artificial Sequence: Synthetic polynucleotide

SEQ ID NO: 2714 - DNA, 108 bp, Artificial Sequence; identical to SEQ ID NO: 2262
  Description of Artificial Sequence: Synthetic polynucleotide

SEQ ID NO: 2715 - DNA, 45 bp, Artificial Sequence; identical to SEQ ID NO: 2264
  Description of Artificial Sequence: Synthetic oligonucleotide

SEQ ID NO: 2716 - DNA, 27 bp, Artificial Sequence
  Description of Artificial Sequence: Synthetic oligonucleotide
ggccgcagcattcatgaaattccgcgc

SEQ ID NO: 2717 - DNA, 63 bp, Artificial Sequence; identical to SEQ ID NO: 2266
  Description of Artificial Sequence: Synthetic oligonucleotide

SEQ ID NO: 2718 - DNA, 36 bp, Artificial Sequence; identical to SEQ ID NO: 2267
  Description of Artificial Sequence: Synthetic oligonucleotide

SEQ ID NO: 2719 - DNA, 39 bp, Artificial Sequence; identical to SEQ ID NO: 2268
  Description of Artificial Sequence: Synthetic oligonucleotide

SEQ ID NO: 2720 - DNA, 60 bp, Artificial Sequence; identical to SEQ ID NO: 2269
  Description of Artificial Sequence: Synthetic oligonucleotide

SEQ ID NO: 2721 - DNA, 39 bp, Artificial Sequence; identical to SEQ ID NO: 2270
  Description of Artificial Sequence: Synthetic oligonucleotide

SEQ ID NO: 2722 - DNA, 51 bp, Artificial Sequence; identical to SEQ ID NO: 2271
  Description of Artificial Sequence: Synthetic oligonucleotide

SEQ ID NO: 2723 - DNA, 84 bp, Artificial Sequence; identical to SEQ ID NO: 2272
  Description of Artificial Sequence: Synthetic oligonucleotide

SEQ ID NO: 2724 - DNA, 33 bp, Artificial Sequence; identical to SEQ ID NO: 2273
  Description of Artificial Sequence: Synthetic oligonucleotide

SEQ ID NO: 2725 - DNA, 48 bp, Artificial Sequence; identical to SEQ ID NO: 2274
  Description of Artificial Sequence: Synthetic oligonucleotide

SEQ ID NO: 2726 - DNA, 39 bp, Artificial Sequence; identical to SEQ ID NO: 2275
  Description of Artificial Sequence: Synthetic oligonucleotide

SEQ ID NO: 2727 - DNA, 24 bp, Artificial Sequence
  Description of Artificial Sequence: Synthetic oligonucleotide
tatcgcgatcgccgccgcccgagc

SEQ ID NO: 2728 - DNA, 39 bp, Artificial Sequence; identical to SEQ ID NO: 2277
  Description of Artificial Sequence: Synthetic oligonucleotide

SEQ ID NO: 2729 - DNA, 27 bp, Artificial Sequence
  Description of Artificial Sequence: Synthetic oligonucleotide
cagcagtggagcagccatatttttacc

SEQ ID NO: 2730 - DNA, 42 bp, Artificial Sequence; identical to SEQ ID NO: 2279
  Description of Artificial Sequence: Synthetic oligonucleotide

SEQ ID NO: 2731 - DNA, 27 bp, Artificial Sequence
  Description of Artificial Sequence: Synthetic oligonucleotide
cagaacggccatagctttccgtttacc

SEQ ID NO: 2732 - DNA, 30 bp, Artificial Sequence; identical to SEQ ID NO: 2281
  Description of Artificial Sequence: Synthetic oligonucleotide

SEQ ID NO: 2733 - DNA, 24 bp, Artificial Sequence
  Description of Artificial Sequence: Synthetic oligonucleotide
gcgcgcaactgggatgtggcgtat

SEQ ID NO: 2734 - DNA, 33 bp, Artificial Sequence; identical to SEQ ID NO: 2283
  Description of Artificial Sequence: Synthetic oligonucleotide

SEQ ID NO: 2735 - DNA, 30 bp, Artificial Sequence; identical to SEQ ID NO: 2284
  Description of Artificial Sequence: Synthetic oligonucleotide

SEQ ID NO: 2736 - DNA, 42 bp, Artificial Sequence; identical to SEQ ID NO: 2285
  Description of Artificial Sequence: Synthetic oligonucleotide

SEQ ID NO: 2737 - DNA, 30 bp, Artificial Sequence; identical to SEQ ID NO: 2286
  Description of Artificial Sequence: Synthetic oligonucleotide

SEQ ID NO: 2738 - DNA, 27 bp, Artificial Sequence
  Description of Artificial Sequence: Synthetic oligonucleotide
ctgatttatccgtataacggctttaac

SEQ ID NO: 2739 - DNA, 39 bp, Artificial Sequence; identical to SEQ ID NO: 2288
  Description of Artificial Sequence: Synthetic oligonucleotide

SEQ ID NO: 2740 - DNA, 45 bp, Artificial Sequence; identical to SEQ ID NO: 2289
  Description of Artificial Sequence: Synthetic oligonucleotide

SEQ ID NO: 2741 - DNA, 27 bp, Artificial Sequence
  Description of Artificial Sequence: Synthetic oligonucleotide
agccgcgattatggctattattttgat

SEQ ID NO: 2742 - DNA, 30 bp, Artificial Sequence; identical to SEQ ID NO: 2291
  Description of Artificial Sequence: Synthetic oligonucleotide

SEQ ID NO: 2743 - DNA, 24 bp, Artificial Sequence
  Description of Artificial Sequence: Synthetic oligonucleotide
cagtggtggtggtggccgagcacc

SEQ ID NO: 2744 - DNA, 36 bp, Artificial Sequence; identical to SEQ ID NO: 2293
  Description of Artificial Sequence: Synthetic oligonucleotide

SEQ ID NO: 2745 - DNA, 24 bp, Artificial Sequence
  Description of Artificial Sequence: Synthetic oligonucleotide
tatgataacaaccagcgcccgagc

SEQ ID NO: 2746 - DNA, 51 bp, Artificial Sequence; identical to SEQ ID NO: 2295
  Description of Artificial Sequence: Synthetic oligonucleotide

SEQ ID NO: 2747 - DNA, 36 bp, Artificial Sequence; identical to SEQ ID NO: 2296
  Description of Artificial Sequence: Synthetic oligonucleotide

SEQ ID NO: 2748 - DNA, 27 bp, Artificial Sequence
  Description of Artificial Sequence: Synthetic oligonucleotide
acccgccatgatggcaccaactttgat

SEQ ID NO: 2749 - DNA, 27 bp, Artificial Sequence
  Description of Artificial Sequence: Synthetic oligonucleotide
cagcaggcgaaagcgtttccgccgacc

SEQ ID NO: 2750 - DNA, 36 bp, Artificial Sequence; identical to SEQ ID NO: 2299
  Description of Artificial Sequence: Synthetic oligonucleotide

SEQ ID NO: 2751 - DNA, 24 bp, Artificial Sequence
  Description of Artificial Sequence: Synthetic oligonucleotide
tggattaacaccgaaaccggcagc

SEQ ID NO: 2752 - DNA, 24 bp, Artificial Sequence
  Description of Artificial Sequence: Synthetic oligonucleotide
tggattaacacctataccggcgaa

SEQ ID NO: 2753 - DNA, 30 bp, Artificial Sequence; identical to SEQ ID NO: 2302
  Description of Artificial Sequence: Synthetic oligonucleotide

SEQ ID NO: 2754 - DNA, 63 bp, Artificial Sequence; identical to SEQ ID NO: 2252
  Description of Artificial Sequence: Synthetic oligonucleotide

SEQ ID NO: 2755 - DNA, 48 bp, Artificial Sequence; identical to SEQ ID NO: 2253
  Description of Artificial Sequence: Synthetic oligonucleotide

SEQ ID NO: 2756 - DNA, 75 bp, Artificial Sequence; identical to SEQ ID NO: 2254
  Description of Artificial Sequence: Synthetic oligonucleotide

SEQ ID NO: 2757 - DNA, 126 bp, Artificial Sequence; identical to SEQ ID NO: 2255
  Description of Artificial Sequence: Synthetic polynucleotide

SEQ ID NO: 2758 - DNA, 96 bp, Artificial Sequence; identical to SEQ ID NO: 2256
  Description of Artificial Sequence: Synthetic oligonucleotide

SEQ ID NO: 2759 - DNA, 45 bp, Artificial Sequence; identical to SEQ ID NO: 2257
  Description of Artificial Sequence: Synthetic oligonucleotide

SEQ ID NO: 2760 - DNA, 60 bp, Artificial Sequence; identical to SEQ ID NO: 2258
  Description of Artificial Sequence: Synthetic oligonucleotide

SEQ ID NO: 2761 - DNA, 42 bp, Artificial Sequence; identical to SEQ ID NO: 2259
  Description of Artificial Sequence: Synthetic oligonucleotide

SEQ ID NO: 2762 - DNA, 102 bp, Artificial Sequence; identical to SEQ ID NO: 2260
  Description of Artificial Sequence: Synthetic polynucleotide

SEQ ID NO: 2763 - DNA, 102 bp, Artificial Sequence; identical to SEQ ID NO: 2261
  Description of Artificial Sequence: Synthetic polynucleotide

SEQ ID NO: 2764 - DNA, 108 bp, Artificial Sequence; identical to SEQ ID NO: 2262
  Description of Artificial Sequence: Synthetic polynucleotide

SEQ ID NO: 2765 - DNA, 108 bp, Artificial Sequence; identical to SEQ ID NO: 2262
  Description of Artificial Sequence: Synthetic polynucleotide

SEQ ID NO: 2766 - DNA, 45 bp, Artificial Sequence; identical to SEQ ID NO: 2264
  Description of Artificial Sequence: Synthetic oligonucleotide

SEQ ID NO: 2767 - DNA, 27 bp, Artificial Sequence
  Description of Artificial Sequence: Synthetic oligonucleotide
ggccgcagcattcatgaaattccgcgc

SEQ ID NO: 2768 - DNA, 63 bp, Artificial Sequence; identical to SEQ ID NO: 2266
  Description of Artificial Sequence: Synthetic oligonucleotide

SEQ ID NO: 2769 - DNA, 36 bp, Artificial Sequence; identical to SEQ ID NO: 2267
  Description of Artificial Sequence: Synthetic oligonucleotide

SEQ ID NO: 2770 - DNA, 39 bp, Artificial Sequence; identical to SEQ ID NO: 2268
  Description of Artificial Sequence: Synthetic oligonucleotide

SEQ ID NO: 2771 - DNA, 60 bp, Artificial Sequence; identical to SEQ ID NO: 2269
  Description of Artificial Sequence: Synthetic oligonucleotide

SEQ ID NO: 2772 - DNA, 39 bp, Artificial Sequence; identical to SEQ ID NO: 2270
  Description of Artificial Sequence: Synthetic oligonucleotide

SEQ ID NO: 2773 - DNA, 51 bp, Artificial Sequence; identical to SEQ ID NO: 2271
  Description of Artificial Sequence: Synthetic oligonucleotide

SEQ ID NO: 2774 - DNA, 84 bp, Artificial Sequence; identical to SEQ ID NO: 2272
  Description of Artificial Sequence: Synthetic oligonucleotide

SEQ ID NO: 2775 - DNA, 33 bp, Artificial Sequence; identical to SEQ ID NO: 2273
  Description of Artificial Sequence: Synthetic oligonucleotide

SEQ ID NO: 2776 - DNA, 48 bp, Artificial Sequence; identical to SEQ ID NO: 2274
  Description of Artificial Sequence: Synthetic oligonucleotide

SEQ ID NO: 2777 - DNA, 39 bp, Artificial Sequence; identical to SEQ ID NO: 2275
  Description of Artificial Sequence: Synthetic oligonucleotide

SEQ ID NO: 2778 - DNA, 24 bp, Artificial Sequence
  Description of Artificial Sequence: Synthetic oligonucleotide
tatcgcgatcgccgccgcccgagc

SEQ ID NO: 2779 - DNA, 39 bp, Artificial Sequence; identical to SEQ ID NO: 2277
  Description of Artificial Sequence: Synthetic oligonucleotide

SEQ ID NO: 2780 - DNA, 27 bp, Artificial Sequence
  Description of Artificial Sequence: Synthetic oligonucleotide
cagcagtggagcagccatatttttacc

SEQ ID NO: 2781 - DNA, 42 bp, Artificial Sequence; identical to SEQ ID NO: 2279
  Description of Artificial Sequence: Synthetic oligonucleotide

SEQ ID NO: 2782 - DNA, 27 bp, Artificial Sequence
  Description of Artificial Sequence: Synthetic oligonucleotide
cagaacggccatagctttccgtttacc

SEQ ID NO: 2783 - DNA, 30 bp, Artificial Sequence; identical to SEQ ID NO: 2281
  Description of Artificial Sequence: Synthetic oligonucleotide

SEQ ID NO: 2784 - DNA, 24 bp, Artificial Sequence
  Description of Artificial Sequence: Synthetic oligonucleotide
gcgcgcaactgggatgtggcgtat

SEQ ID NO: 2785 - DNA, 33 bp, Artificial Sequence; identical to SEQ ID NO: 2283
  Description of Artificial Sequence: Synthetic oligonucleotide

SEQ ID NO: 2786 - DNA, 30 bp, Artificial Sequence; identical to SEQ ID NO: 2284
  Description of Artificial Sequence: Synthetic oligonucleotide

SEQ ID NO: 2787 - DNA, 42 bp, Artificial Sequence; identical to SEQ ID NO: 2285
  Description of Artificial Sequence: Synthetic oligonucleotide

SEQ ID NO: 2788 - DNA, 30 bp, Artificial Sequence; identical to SEQ ID NO: 2286
  Description of Artificial Sequence: Synthetic oligonucleotide

SEQ ID NO: 2789 - DNA, 27 bp, Artificial Sequence
  Description of Artificial Sequence: Synthetic oligonucleotide
ctgatttatccgtataacggctttaac

SEQ ID NO: 2790 - DNA, 39 bp, Artificial Sequence; identical to SEQ ID NO: 2288
  Description of Artificial Sequence: Synthetic oligonucleotide

SEQ ID NO: 2791 - DNA, 45 bp, Artificial Sequence; identical to SEQ ID NO: 2289
  Description of Artificial Sequence: Synthetic oligonucleotide

SEQ ID NO: 2792 - DNA, 27 bp, Artificial Sequence
  Description of Artificial Sequence: Synthetic oligonucleotide
agccgcgattatggctattattttgat

SEQ ID NO: 2793 - DNA, 30 bp, Artificial Sequence; identical to SEQ ID NO: 2291
  Description of Artificial Sequence: Synthetic oligonucleotide

SEQ ID NO: 2794 - DNA, 24 bp, Artificial Sequence
  Description of Artificial Sequence: Synthetic oligonucleotide
cagtggtggtggtggccgagcacc

SEQ ID NO: 2795 - DNA, 36 bp, Artificial Sequence; identical to SEQ ID NO: 2293
  Description of Artificial Sequence: Synthetic oligonucleotide

SEQ ID NO: 2796 - DNA, 24 bp, Artificial Sequence
  Description of Artificial Sequence: Synthetic oligonucleotide
tatgataacaaccagcgcccgagc

SEQ ID NO: 2797 - DNA, 51 bp, Artificial Sequence; identical to SEQ ID NO: 2295
  Description of Artificial Sequence: Synthetic oligonucleotide

SEQ ID NO: 2798 - DNA, 36 bp, Artificial Sequence; identical to SEQ ID NO: 2296
  Description of Artificial Sequence: Synthetic oligonucleotide

SEQ ID NO: 2799 - DNA, 27 bp, Artificial Sequence
  Description of Artificial Sequence: Synthetic oligonucleotide
acccgccatgatggcaccaactttgat

SEQ ID NO: 2800 - DNA, 27 bp, Artificial Sequence
  Description of Artificial Sequence: Synthetic oligonucleotide
cagcaggcgaaagcgtttccgccgacc

SEQ ID NO: 2801 - DNA, 36 bp, Artificial Sequence; identical to SEQ ID NO: 2299
  Description of Artificial Sequence: Synthetic oligonucleotide

SEQ ID NO: 2802 - DNA, 24 bp, Artificial Sequence
  Description of Artificial Sequence: Synthetic oligonucleotide
tggattaacaccgaaaccggcagc

SEQ ID NO: 2803 - DNA, 24 bp, Artificial Sequence
  Description of Artificial Sequence: Synthetic oligonucleotide
tggattaacacctataccggcgaa

SEQ ID NO: 2804 - DNA, 30 bp, Artificial Sequence; identical to SEQ ID NO: 2302
  Description of Artificial Sequence: Synthetic oligonucleotide

SEQ ID NO: 2805 - protein, 12 aa, Artificial Sequence
  Description of Artificial Sequence: Synthetic peptide
FAAYWNLLSAYG

SEQ ID NO: 2806 - protein, 9 aa, Artificial Sequence
  Description of Artificial Sequence: Synthetic peptide
RFMDYWEGL

SEQ ID NO: 2807 - protein, 14 aa, Artificial Sequence
  Description of Artificial Sequence: Synthetic peptide
TSFAEYWALLAENL

SEQ ID NO: 2808 - protein, 7 aa, Artificial Sequence
  Description of Artificial Sequence: Synthetic peptide
EAQWAAL

SEQ ID NO: 2809 - protein, 8 aa, Artificial Sequence
  Description of Artificial Sequence: Synthetic peptide
FEAQWAAL

SEQ ID NO: 2810 - protein, 8 aa, Artificial Sequence
  Description of Artificial Sequence: Synthetic peptide
FQHIWDFL

SEQ ID NO: 2811 - protein, 8 aa, Artificial Sequence
  Description of Artificial Sequence: Synthetic peptide
FEHLWSSL

SEQ ID NO: 2812 - protein, 12 aa, Artificial Sequence
  Description of Artificial Sequence: Synthetic peptide
AGSNEQEPKKRS

SEQ ID NO: 2813 - protein, 7 aa, Artificial Sequence
  Description of Artificial Sequence: Synthetic peptide
DPETGEL

SEQ ID NO: 2814 - protein, 7 aa, Artificial Sequence
  Description of Artificial Sequence: Synthetic peptide
DPSTGEL

SEQ ID NO: 2815 - protein, 6 aa, Artificial Sequence
  Description of Artificial Sequence: Synthetic peptide
NQETGE

SEQ ID NO: 2816 - protein, 6 aa, Artificial Sequence
  Description of Artificial Sequence: Synthetic peptide
SPETGE

SEQ ID NO: 2817 - protein, 6 aa, Artificial Sequence
  Description of Artificial Sequence: Synthetic peptide
NEENGE

SEQ ID NO: 2818 - protein, 6 aa, Artificial Sequence
  Description of Artificial Sequence: Synthetic peptide
DPENGE

SEQ ID NO: 2819 - protein, 6 aa, Artificial Sequence
  Description of Artificial Sequence: Synthetic peptide
NVESGE

SEQ ID NO: 2820 - protein, 6 aa, Artificial Sequence
  Description of Artificial Sequence: Synthetic peptide
DEETGE

SEQ ID NO: 2821 - protein, 6 aa, Artificial Sequence
  Description of Artificial Sequence: Synthetic peptide
DEETGE

SEQ ID NO: 2822 - protein, 7 aa, Artificial Sequence
  Description of Artificial Sequence: Synthetic peptide
  MOD_RES (3)..(3): Any amino acid
QDXDLGV

SEQ ID NO: 2823 - protein, 12 aa, Artificial Sequence
  Description of Artificial Sequence: Synthetic peptide
ELDSPSSTSSSS

SEQ ID NO: 2824 - protein, 15 aa, Artificial Sequence
  Description of Artificial Sequence: Synthetic peptide
LACDEVTSTTSSSTA

SEQ ID NO: 2825 - protein, 5 aa, Artificial Sequence
  Description of Artificial Sequence: Synthetic peptide
ASSTT

SEQ ID NO: 2826 - protein, 11 aa, Artificial Sequence
  Description of Artificial Sequence: Synthetic peptide
DEVTSTTSSST

SEQ ID NO: 2827 - protein, 10 aa, Artificial Sequence
  Description of Artificial Sequence: Synthetic peptide
  MOD_RES (2)..(2): Any amino acid
  MOD_RES (5)..(5): Any amino acid
  MOD_RES (7)..(7): A or V
EXEEXEXDQH

SEQ ID NO: 2828 - protein, 10 aa, Artificial Sequence
  Description of Artificial Sequence: Synthetic peptide
EPEEPEADQH

SEQ ID NO: 2829 - protein, 10 aa, Artificial Sequence
  Description of Artificial Sequence: Synthetic peptide
ECEETEVDQH

SEQ ID NO: 2830 - protein, 10 aa, Artificial Sequence
  Description of Artificial Sequence: Synthetic peptide
EPEEPEADQH

SEQ ID NO: 2831 - protein, 11 aa, Artificial Sequence
  Description of Artificial Sequence: Synthetic peptide
ILWRQDIDLGV

SEQ ID NO: 2832 - protein, 16 aa, Artificial Sequence
  Description of Artificial Sequence: Synthetic peptide
SLSSAFHVFEDGNKEN

SEQ ID NO: 2833 - protein, 6 aa, Artificial Sequence
  Description of Artificial Sequence: Synthetic peptide
FTIHVD

SEQ ID NO: 2834 - protein, 4 aa, Artificial Sequence
  Description of Artificial Sequence: Synthetic peptide
QRVL

SEQ ID NO: 2835 - protein, 9 aa, Artificial Sequence
  Description of Artificial Sequence: Synthetic peptide
SEDKENVPP

SEQ ID NO: 2836 - protein, 9 aa, Artificial Sequence
  Description of Artificial Sequence: Synthetic peptide
RLSLSPKKN

SEQ ID NO: 2837 - protein, 9 aa, Artificial Sequence
  Description of Artificial Sequence: Synthetic peptide
RSSLKKHCN

SEQ ID NO: 2838 - protein, 9 aa, Artificial Sequence
  Description of Artificial Sequence: Synthetic peptide
HLSLKDITN

SEQ ID NO: 2839 - protein, 7 aa, Artificial Sequence
  Description of Artificial Sequence: Synthetic peptide
RSPLFIF

SEQ ID NO: 2840 - protein, 7 aa, Artificial Sequence
  Description of Artificial Sequence: Synthetic peptide
RSSLLSR

SEQ ID NO: 2841 - protein, 7 aa, Artificial Sequence
  Description of Artificial Sequence: Synthetic peptide
RKALGTV

SEQ ID NO: 2842 - protein, 7 aa, Artificial Sequence
  Description of Artificial Sequence: Synthetic peptide
RKALGTV

SEQ ID NO: 2843 - protein, 7 aa, Artificial Sequence
  Description of Artificial Sequence: Synthetic peptide
RLCLPQV

SEQ ID NO: 2844 - protein, 7 aa, Artificial Sequence
  Description of Artificial Sequence: Synthetic peptide
RLPLAQV

SEQ ID NO: 2845 - protein, 9 aa, Artificial Sequence
  Description of Artificial Sequence: Synthetic peptide
NRKPLTVLN

SEQ ID NO: 2846 - protein, 7 aa, Artificial Sequence
  Description of Artificial Sequence: Synthetic peptide
RAALAVL

SEQ ID NO: 2847 - protein, 9 aa, Artificial Sequence
  Description of Artificial Sequence: Synthetic peptide
PRTALGDIG

SEQ ID NO: 2848 - protein, 9 aa, Artificial Sequence
  Description of Artificial Sequence: Synthetic peptide
RSAFEDLTN

SEQ ID NO: 2849 - protein, 9 aa, Artificial Sequence
  Description of Artificial Sequence: Synthetic peptide
HRKHLQEIP

SEQ ID NO: 2850 - protein, 7 aa, Artificial Sequence
  Description of Artificial Sequence: Synthetic peptide
RSGLQLS

SEQ ID NO: 2851 - protein, 7 aa, Artificial Sequence
  Description of Artificial Sequence: Synthetic peptide
RRGLILA

SEQ ID NO: 2852 - protein, 7 aa, Artificial Sequence
  Description of Artificial Sequence: Synthetic peptide
RHCLPTL

SEQ ID NO: 2853 - protein, 7 aa, Artificial Sequence
  Description of Artificial Sequence: Synthetic peptide
RNLLHDN

SEQ ID NO: 2854 - protein, 7 aa, Artificial Sequence
  Description of Artificial Sequence: Synthetic peptide
RAALDRL

SEQ ID NO: 2855 - protein, 4 aa, Artificial Sequence
  Description of Artificial Sequence: Synthetic peptide
RKKL

SEQ ID NO: 2856 - protein, 4 aa, Artificial Sequence
  Description of Artificial Sequence: Synthetic peptide
RRRL

SEQ ID NO: 2857 - protein, 7 aa, Artificial Sequence
  Description of Artificial Sequence: Synthetic peptide
RARLCSS

SEQ ID NO: 2858 - protein, 7 aa, Artificial Sequence
  Description of Artificial Sequence: Synthetic peptide
RLPLVPE

SEQ ID NO: 2859 - protein, 7 aa, Artificial Sequence
  Description of Artificial Sequence: Synthetic peptide
RKKLVLE

SEQ ID NO: 2860 - protein, 7 aa, Artificial Sequence
  Description of Artificial Sequence: Synthetic peptide
RENLQRK

SEQ ID NO: 2861 - protein, 7 aa, Artificial Sequence
  Description of Artificial Sequence: Synthetic peptide
RQPLSEA

SEQ ID NO: 2862 - protein, 7 aa, Artificial Sequence
  Description of Artificial Sequence: Synthetic peptide
RTQLETK

SEQ ID NO: 2863 - protein, 7 aa, Artificial Sequence
  Description of Artificial Sequence: Synthetic peptide
RNSLRQT

SEQ ID NO: 2864 - protein, 7 aa, Artificial Sequence
  Description of Artificial Sequence: Synthetic peptide
RYGLHPD

SEQ ID NO: 2865 - protein, 11 aa, Artificial Sequence
  Description of Artificial Sequence: Synthetic peptide
PRLPLGDVSNN

SEQ ID NO: 2866 - protein, 5 aa, Artificial Sequence
  Description of Artificial Sequence: Synthetic peptide
AKENE

SEQ ID NO: 2867 - protein, 5 aa, Artificial Sequence
  Description of Artificial Sequence: Synthetic peptide
SKENV

SEQ ID NO: 2868 - protein, 8 aa, Artificial Sequence
  Description of Artificial Sequence: Synthetic peptide
PFLTPSPE

SEQ ID NO: 2869 - protein, 7 aa, Artificial Sequence
  Description of Artificial Sequence: Synthetic peptide
PGTPPSS

SEQ ID NO: 2870 - protein, 7 aa, Artificial Sequence
  Description of Artificial Sequence: Synthetic peptide
LLTPPQS

SEQ ID NO: 2871 - protein, 8 aa, Artificial Sequence
  Description of Artificial Sequence: Synthetic peptide
PFLTPSPE

SEQ ID NO: 2872 - protein, 8 aa, Artificial Sequence
  Description of Artificial Sequence: Synthetic peptide
SLIPTPDK

SEQ ID NO: 2873 - protein, 12 aa, Artificial Sequence
  Description of Artificial Sequence: Synthetic peptide
PEQTSEPTDVAI

SEQ ID NO: 2874 - protein, 6 aa, Artificial Sequence
  Description of Artificial Sequence: Synthetic peptide
SDSEPD

SEQ ID NO: 2875 - protein, 8 aa, Artificial Sequence
  Description of Artificial Sequence: Synthetic peptide
SLIPEPDR

SEQ ID NO: 2876 - protein, 7 aa, Artificial Sequence
  Description of Artificial Sequence: Synthetic peptide
SGVETSF

SEQ ID NO: 2877 - protein, 7 aa, Artificial Sequence
  Description of Artificial Sequence: Synthetic peptide
LKLKKSL

SEQ ID NO: 2878 - protein, 5 aa, Artificial Sequence
  Description of Artificial Sequence: Synthetic peptide
SGLDS

SEQ ID NO: 2879 - protein, 6 aa, Artificial Sequence
  Description of Artificial Sequence: Synthetic peptide
DSGIES

SEQ ID NO: 2880 - protein, 10 aa, Artificial Sequence
  Description of Artificial Sequence: Synthetic peptide
SSRDSGRGDS

SEQ ID NO: 2881 - protein, 6 aa, Artificial Sequence
  Description of Artificial Sequence: Synthetic peptide
DSGLGS

SEQ ID NO: 2882 - protein, 6 aa, Artificial Sequence
  Description of Artificial Sequence: Synthetic peptide
EPPLEP

SEQ ID NO: 2883 - protein, 13 aa, Artificial Sequence
  Description of Artificial Sequence: Synthetic peptide
  MOD_RES (1)..(1): Any amino acid
  MOD_RES (2)..(2): V, L, I, or A
  MOD_RES (3)..(3): V, L, or I
  MOD_RES (8)..(8): V, L, or I
  MOD_RES (9)..(11): Any amino acid
  MOD_RES (13)..(13): Any amino acid
XXXGWPPXXXXRX

SEQ ID NO: 2884 - protein, 12 aa, Artificial Sequence
  Description of Artificial Sequence: Synthetic peptide
QRRMTDFYARRR

SEQ ID NO: 2885 - protein, 12 aa, Artificial Sequence
  Description of Artificial Sequence: Synthetic peptide
TVAYFTLQQVYG

SEQ ID NO: 2886 - protein, 13 aa, Artificial Sequence
  Description of Artificial Sequence: Synthetic peptide
ILPAVLHLRTVYG

SEQ ID NO: 2887 - protein, 13 aa, Artificial Sequence
  Description of Artificial Sequence: Synthetic peptide
NFVAWHALRQVYG

SEQ ID NO: 2888 - protein, 13 aa, Artificial Sequence
  Description of Artificial Sequence: Synthetic peptide
NITADLILRQVYG

SEQ ID NO: 2889 - protein, 4 aa, Artificial Sequence
  Description of Artificial Sequence: Synthetic peptide
RRRG

SEQ ID NO: 2890 - protein, 4 aa, Artificial Sequence
  Description of Artificial Sequence: Synthetic peptide
DINN

SEQ ID NO: 2891 - protein, 6 aa, Artificial Sequence
  Description of Artificial Sequence: Synthetic peptide
DSGIGT

SEQ ID NO: 2892 - protein, 6 aa, Artificial Sequence
  Description of Artificial Sequence: Synthetic peptide
DEGNYE

SEQ ID NO: 2893 - protein, 6 aa, Artificial Sequence
  Description of Artificial Sequence: Synthetic peptide
  MOD_RES (4)..(5): Any amino acid
DSGXXS

SEQ ID NO: 2894 - protein, 9 aa, Artificial Sequence
  Description of Artificial Sequence: Synthetic peptide
SEGSDDSGL

SEQ ID NO: 2895 - protein, 7 aa, Artificial Sequence
  Description of Artificial Sequence: Synthetic peptide
TDSGRGS

SEQ ID NO: 2896 - protein, 6 aa, Artificial Sequence
  Description of Artificial Sequence: Synthetic peptide
DSGYNT

SEQ ID NO: 2897 - protein, 7 aa, Artificial Sequence
  Description of Artificial Sequence: Synthetic peptide
YSGNLES

SEQ ID NO: 2898 - protein, 14 aa, Artificial Sequence
  Description of Artificial Sequence: Synthetic peptide
SQTSTPTDVTAIHL

SEQ ID NO: 2899 - protein, 7 aa, Artificial Sequence
  Description of Artificial Sequence: Synthetic peptide
PTDVTAI

SEQ ID NO: 2900 - protein, 15 aa, Artificial Sequence
  Description of Artificial Sequence: Synthetic peptide
EEEVSLASEPTDVRD

SEQ ID NO: 2901 - protein, 14 aa, Artificial Sequence
  Description of Artificial Sequence: Synthetic peptide
  MOD_RES (1)..(2): R or K
  MOD_RES (3)..(3): Any amino acid
  MOD_RES (6)..(6): Any amino acid
  MOD_RES (8)..(8): F, L, or M
  MOD_RES (9)..(9): Any amino acid
  MOD_RES (10)..(10): R or K
  MOD_RES (12)..(12): H, R, or K
  MOD_RES (13)..(13): Any amino acid
  MOD_RES (14)..(14): R or K
XXXSLXFXXXRXXX

SEQ ID NO: 2902 - protein, 8 aa, Artificial Sequence
  Description of Artificial Sequence: Synthetic peptide
ASRMEEVD

SEQ ID NO: 2903 - protein, 8 aa, Artificial Sequence
  Description of Artificial Sequence: Synthetic peptide
GPTIEEVD

SEQ ID NO: 2904 - protein, 20 aa, Artificial Sequence
  Description of Artificial Sequence: Synthetic peptide
DINNNNNIVEDVERKREFYI

SEQ ID NO: 2905 - protein, 14 aa, Artificial Sequence
  Description of Artificial Sequence: Synthetic peptide
SKLSVNAPEFYPSG

SEQ ID NO: 2906 - protein, 6 aa, Artificial Sequence
  Description of Artificial Sequence: Synthetic peptide
IGLLGG

SEQ ID NO: 2907 - protein, 4 aa, Artificial Sequence
  Description of Artificial Sequence: Synthetic peptide
PGLW

SEQ ID NO: 2908 - protein, 11 aa, Artificial Sequence
  Description of Artificial Sequence: Synthetic peptide
TAPPPAYATLG

SEQ ID NO: 2909 - protein, 10 aa, Artificial Sequence
  Description of Artificial Sequence: Synthetic peptide
  MOD_RES (3)..(5): Any amino acid
  MOD_RES (7)..(9): Any amino acid
SLXXXLXXXI

SEQ ID NO: 2910 - protein, 9 aa, Artificial Sequence
  Description of Artificial Sequence: Synthetic peptide
SRTPLTTLN

SEQ ID NO: 2911 - protein, 7 aa, Artificial Sequence
  Description of Artificial Sequence: Synthetic peptide
DGYTPEP

SEQ ID NO: 2912 - protein, 9 aa, Artificial Sequence
  Description of Artificial Sequence: Synthetic peptide
RPTAAVTPI

SEQ ID NO: 2913 - protein, 7 aa, Artificial Sequence
  Description of Artificial Sequence: Synthetic peptide
DEQFVPD

SEQ ID NO: 2914 - protein, 14 aa, Artificial Sequence
  Description of Artificial Sequence: Synthetic peptide
LAPYIPMDGEDFQL

SEQ ID NO: 2915 - protein, 21 aa, Artificial Sequence
  Description of Artificial Sequence: Synthetic peptide
YVGLVWGVLLTTELIVWAASA

SEQ ID NO: 2916 - protein, 12 aa, Artificial Sequence
  Description of Artificial Sequence: Synthetic peptide
PKTPPSSCDSTN

SEQ ID NO: 2917 - protein, 10 aa, Artificial Sequence
  Description of Artificial Sequence: Synthetic peptide
RAIDNQYTPL

SEQ ID NO: 2918 - protein, 12 aa, Artificial Sequence
  Description of Artificial Sequence: Synthetic peptide
IRGSNEYTEGPS

SEQ ID NO: 2919 - protein, 12 aa, Artificial Sequence
  Description of Artificial Sequence: Synthetic peptide
IRNTNEYTEGPT

SEQ ID NO: 2920 - protein, 11 aa, Artificial Sequence
  Description of Artificial Sequence: Synthetic peptide
HVENDYIDNPS

SEQ ID NO: 2921 - protein, 10 aa, Artificial Sequence
  Description of Artificial Sequence: Synthetic peptide
SFNPYEPELA

SEQ ID NO: 2922 - protein, 12 aa, Artificial Sequence
  Description of Artificial Sequence: Synthetic peptide
TLNSDGYTPEPA

SEQ ID NO: 2923 - protein, 11 aa, Artificial Sequence
  Description of Artificial Sequence: Synthetic peptide
IPFLDYRTYAV

SEQ ID NO: 2924 - protein, 11 aa, Artificial Sequence
  Description of Artificial Sequence: Synthetic peptide
IPFLDYRTYAM

SEQ ID NO: 2925 - protein, 12 aa, Artificial Sequence
  Description of Artificial Sequence: Synthetic peptide
SIFDNLYTTLSD

SEQ ID NO: 2926 - protein, 12 aa, Artificial Sequence
  Description of Artificial Sequence: Synthetic peptide
SIFNSLYTTLSD

SEQ ID NO: 2927 - protein, 12 aa, Artificial Sequence
  Description of Artificial Sequence: Synthetic peptide
KGDGGLYSSLPP

SEQ ID NO: 2928 - protein, 8 aa, Artificial Sequence
  Description of Artificial Sequence: Synthetic peptide
SDQIVPEY

SEQ ID NO: 2929 - protein, 9 aa, Artificial Sequence
  Description of Artificial Sequence: Synthetic peptide
RPTAAVTPI

SEQ ID NO: 2930 - protein, 8 aa, Artificial Sequence
  Description of Artificial Sequence: Synthetic peptide
SDQIVPEY

SEQ ID NO: 2931 - protein, 9 aa, Artificial Sequence
  Description of Artificial Sequence: Synthetic peptide
  MOD_RES (1)..(1): Any amino acid
  MOD_RES (3)..(3): Any amino acid
  MOD_RES (5)..(5): Any amino acid
  MOD_RES (7)..(7): Any amino acid
  MOD_RES (9)..(9): Any amino acid except P
XPXAXVXPX

SEQ ID NO: 2932 - protein, 9 aa, Artificial Sequence
  Description of Artificial Sequence: Synthetic peptide
KPTAYVRPM

SEQ ID NO: 2933 - protein, 9 aa, Artificial Sequence
  Description of Artificial Sequence: Synthetic peptide
KPAAVVAPI

SEQ ID NO: 2934 - protein, 9 aa, Artificial Sequence
  Description of Artificial Sequence: Synthetic peptide
APTAVVLPH

SEQ ID NO: 2935 - protein, 9 aa, Artificial Sequence
  Description of Artificial Sequence: Synthetic peptide
PPRALVLPH

SEQ ID NO: 2936 - protein, 16 aa, Artificial Sequence
  Description of Artificial Sequence: Synthetic peptide
ACKNWFSSLSHFVIHL

SEQ ID NO: 2937 - protein, 7 aa, Artificial Sequence
  Description of Artificial Sequence: Synthetic peptide
  MOD_RES (4)..(6): Any amino acid
LYPXXXL

SEQ ID NO: 2938 - protein, 10 aa, Artificial Sequence
  Description of Artificial Sequence: Synthetic peptide
ELYPLTSLRS

SEQ ID NO: 2939 - protein, 20 aa, Artificial Sequence
  Description of Artificial Sequence: Synthetic peptide
SREKPYKEVTEDLLHLNSLF

SEQ ID NO: 2940 - protein, 18 aa, Artificial Sequence
  Description of Artificial Sequence: Synthetic peptide
AAGAYDPARKLLEQYAKK

SEQ ID NO: 2941 - protein, 5 aa, Artificial Sequence
  Description of Artificial Sequence: Synthetic peptide
KFERQ

SEQ ID NO: 2942 - protein, 5 aa, Artificial Sequence
  Description of Artificial Sequence: Synthetic peptide
QRFFE

SEQ ID NO: 2943 - protein, 15 aa, Artificial Sequence
  Description of Artificial Sequence: Synthetic peptide
TASDDSDIVTLEPPK

SEQ ID NO: 2944 - protein, 12 aa, Artificial Sequence
  Description of Artificial Sequence: Synthetic peptide
EVRDRMWLKITI

SEQ ID NO: 2945 - DNA, 27 bp, Artificial Sequence
  Description of Artificial Sequence: Synthetic oligonucleotide
  misc_feature (4)..(12): This region may encompass any codons except "ccn"
  misc_feature (16)..(24): This region may encompass 2-3 "nnn" repeating units where "nnn" is any codon except "ccn"
  misc_feature (25)..(27): This region may encompass "gtg" or "att" or "ctg"
tttnnnnnnnnntggnnnnnnnnnnnn

SEQ ID NO: 2946 - DNA, 36 bp, Artificial Sequence; identical to SEQ ID NO: 83
  Description of Artificial Sequence: Synthetic oligonucleotide

SEQ ID NO: 2947 - DNA, 27 bp, Artificial Sequence
  Description of Artificial Sequence: Synthetic oligonucleotide
cgcttcatggattattgggaaggtctg

SEQ ID NO: 2948 - DNA, 42 bp, Artificial Sequence; identical to SEQ ID NO: 89
  Description of Artificial Sequence: Synthetic oligonucleotide

SEQ ID NO: 2949 - DNA, 21 bp, Artificial Sequence
  Description of Artificial Sequence: Synthetic oligonucleotide
gaagcgcagtgggcggcgctg

SEQ ID NO: 2950 - DNA, 24 bp, Artificial Sequence
  Description of Artificial Sequence: Synthetic oligonucleotide
tttgaagcgcagtgggcggcgctg

SEQ ID NO: 2951 - DNA, 24 bp, Artificial Sequence
  Description of Artificial Sequence: Synthetic oligonucleotide
tttcagcatatttgggattttctg

SEQ ID NO: 2952 - DNA, 24 bp, Artificial Sequence
  Description of Artificial Sequence: Synthetic oligonucleotide
tttgaacatctgtggagcagcctg

SEQ ID NO: 2953 - DNA, 21 bp, Artificial Sequence
  Description of Artificial Sequence: Synthetic oligonucleotide
  modified_base (1)..(3): n is a, c, g, or t
  misc_feature (4)..(6): This region may encompass "gat" or "gaa"
  modified_base (7)..(9): n is a, c, g, or t
  modified_base (16)..(18): n is a, c, g, or t
nnnnnnnnnaccccgnnnaaa

SEQ ID NO: 2954 - DNA, 36 bp, Artificial Sequence; identical to SEQ ID NO: 91
  Description of Artificial Sequence: Synthetic oligonucleotide

SEQ ID NO: 2955 - DNA, 18 bp, Artificial Sequence
  Description of Artificial Sequence: Synthetic oligonucleotide
  misc_feature (1)..(3): This region may encompass "gac" or "aac" or "agc"
  modified_base (4)..(6): n is a, c, g, or t
  misc_feature (7)..(9): This region may encompass "gac" or "gaa" or "agc"
  misc_feature (10)..(12): This region may encompass "acc" or "aac" or "agc"
nnnnnnnnnnnnggcgaa

SEQ ID NO: 2956 - DNA, 21 bp, Artificial Sequence
  Description of Artificial Sequence: Synthetic oligonucleotide
gatccggaaaccggtgaactg

SEQ ID NO: 2957 - DNA, 21 bp, Artificial Sequence
  Description of Artificial Sequence: Synthetic oligonucleotide
gatccgagcaccggcgaactg

SEQ ID NO: 2958 - DNA, 18 bp, Artificial Sequence
  Description of Artificial Sequence: Synthetic oligonucleotide
aaccaggaaaccggcgaa

SEQ ID NO: 2959 - DNA, 18 bp, Artificial Sequence
  Description of Artificial Sequence: Synthetic oligonucleotide
agcccggaaaccggcgaa

SEQ ID NO: 2960 - DNA, 18 bp, Artificial Sequence
  Description of Artificial Sequence: Synthetic oligonucleotide
aacgaagaaaacggcgaa

SEQ ID NO: 2961 - DNA, 18 bp, Artificial Sequence
  Description of Artificial Sequence: Synthetic oligonucleotide
gatccggaaaacggcgaa

SEQ ID NO: 2962 - DNA, 18 bp, Artificial Sequence
  Description of Artificial Sequence: Synthetic oligonucleotide
aacgtggaaagcggcgaa

SEQ ID NO: 2963 - DNA, 18 bp, Artificial Sequence
  Description of Artificial Sequence: Synthetic oligonucleotide
gatgaagaaaccggcgaa

SEQ ID NO: 2964 - DNA, 18 bp, Artificial Sequence
  Description of Artificial Sequence: Synthetic oligonucleotide
gatgaagaaaccggcgaa

SEQ ID NO: 2965 - DNA, 21 bp, Artificial Sequence
  Description of Artificial Sequence: Synthetic oligonucleotide
  modified_base (7)..(9): n is a, c, g, or t
caggatnnngatctgggtgtg

SEQ ID NO: 2966 - DNA, 36 bp, Artificial Sequence
  Description of Artificial Sequence: Synthetic oligonucleotide
gaactggatagcccgagcagcaccagcagcagcagc

SEQ ID NO: 2967 - DNA, 45 bp, Artificial Sequence; identical to SEQ ID NO: 95
  Description of Artificial Sequence: Synthetic oligonucleotide

SEQ ID NO: 2968 - DNA, 15 bp, Artificial Sequence
  Description of Artificial Sequence: Synthetic oligonucleotide
gcgagcagcaccacc

SEQ ID NO: 2969 - DNA, 33 bp, Artificial Sequence
  Description of Artificial Sequence: Synthetic oligonucleotide
gatgaagtgaccagcaccaccagcagcagcacc

SEQ ID NO: 2970 - DNA, 30 bp, Artificial Sequence
  Description of Artificial Sequence: Synthetic oligonucleotide
  modified_base (4)..(6): n is a, c, g, or t
  modified_base (13)..(15): n is a, c, g, or t
  misc_feature (19)..(21): This region may encompass "gcg" or "gtg"
gaannngaagaannngaannngataaccat

SEQ ID NO: 2971 - DNA, 30 bp, Artificial Sequence
  Description of Artificial Sequence: Synthetic oligonucleotide
gaaccggaagaaccggaagcggatcagcat

SEQ ID NO: 2972 - DNA, 30 bp, Artificial Sequence
  Description of Artificial Sequence: Synthetic oligonucleotide
gaatgcgaagaaaccgaagtggatcagcat

SEQ ID NO: 2973 - DNA, 30 bp, Artificial Sequence; identical to SEQ ID NO: 2971
  Description of Artificial Sequence: Synthetic oligonucleotide

SEQ ID NO: 2974 - DNA, 33 bp, Artificial Sequence
  Description of Artificial Sequence: Synthetic oligonucleotide
attctgtggcgccaggatattgatctgggcgtg

SEQ ID NO: 2975 - DNA, 48 bp, Artificial Sequence
  Description of Artificial Sequence: Synthetic oligonucleotide
agcctgagcagcgcgtttcatgtgtttgaagatggcaacaaagaaaac

SEQ ID NO: 2976 - DNA, 18 bp, Artificial Sequence
  Description of Artificial Sequence: Synthetic oligonucleotide
tttaccattcatgtggat

SEQ ID NO: 2977 - DNA, 12 bp, Artificial Sequence
  Description of Artificial Sequence: Synthetic oligonucleotide
cagcgtgttctg

SEQ ID NO: 2978 - DNA, 15 bp, Artificial Sequence
  Description of Artificial Sequence: Synthetic oligonucleotide
  modified_base (1)..(3): n is a, c, g, or t
  modified_base (13)..(15): n is a, c, g, or t
nnnaaagaaaacnnn

SEQ ID NO: 2979 - DNA, 27 bp, Artificial Sequence
  Description of Artificial Sequence: Synthetic oligonucleotide
agcgaggataaagaaaatgttccgcct

SEQ ID NO: 2980 - DNA, 27 bp, Artificial Sequence
  Description of Artificial Sequence: Synthetic oligonucleotide
  modified_base (1)..(3): n is a, c, g, or t
  modified_base (7)..(12): n is a, c, g, or t
  modified_base (16)..(21): n is a, c, g, or t
  misc_feature (22)..(24): This region may encompass "ctg" or "att" or "gtg" or "atg"
  modified_base (25)..(27): n is a, c, g, or t
nnncgtnnnnnnctgnnnnnnnnnnnn

SEQ ID NO: 2981 - DNA, 27 bp, Artificial Sequence
  Description of Artificial Sequence: Synthetic oligonucleotide
cgcctgagcctgagcccgaaaaaaaac

SEQ ID NO: 2982 - DNA, 27 bp, Artificial Sequence
  Description of Artificial Sequence: Synthetic oligonucleotide
cgcagcagcctgaaaaaacattgcaac

SEQ ID NO: 2983 - DNA, 27 bp, Artificial Sequence
  Description of Artificial Sequence: Synthetic oligonucleotide
catctgagcctgaaagatattaccaac

SEQ ID NO: 2984 - DNA, 21 bp, Artificial Sequence
  Description of Artificial Sequence: Synthetic oligonucleotide
cgcagcccgctgtttattttt

SEQ ID NO: 2985 - DNA, 21 bp, Artificial Sequence
  Description of Artificial Sequence: Synthetic oligonucleotide
cgcagcagcctgctgagccgc

SEQ ID NO: 2986 - DNA, 21 bp, Artificial Sequence
  Description of Artificial Sequence: Synthetic oligonucleotide
cgcaaagcgctgggcaccgtg

SEQ ID NO: 2987 - DNA, 21 bp, Artificial Sequence
  Description of Artificial Sequence: Synthetic oligonucleotide
cgcaaagcgctgggcaccgtg

SEQ ID NO: 2988 - DNA, 21 bp, Artificial Sequence
  Description of Artificial Sequence: Synthetic oligonucleotide
cgcctgtgcctgccgcaggtg

SEQ ID NO: 2989 - DNA, 21 bp, Artificial Sequence
  Description of Artificial Sequence: Synthetic oligonucleotide
cgcctgccgctggcgcaggtg

SEQ ID NO: 2990 - DNA, 27 bp, Artificial Sequence
  Description of Artificial Sequence: Synthetic oligonucleotide
aacaggaagcccctgaccgtgctgaac

SEQ ID NO: 2991 - DNA, 21 bp, Artificial Sequence
  Description of Artificial Sequence: Synthetic oligonucleotide
cgcgcggcgctggcggtgctg

SEQ ID NO: 2992 - DNA, 27 bp, Artificial Sequence
  Description of Artificial Sequence: Synthetic oligonucleotide
ccgcgcaccgcgctgggcgatattggc

SEQ ID NO: 2993 - DNA, 27 bp, Artificial Sequence
  Description of Artificial Sequence: Synthetic oligonucleotide
cgcagcgcgtttgaagatctgaccaac

SEQ ID NO: 2994 - DNA, 27 bp, Artificial Sequence
  Description of Artificial Sequence: Synthetic oligonucleotide
catcgcaaacatctgcaggaaattccg

SEQ ID NO: 2995 - DNA, 21 bp, Artificial Sequence
  Description of Artificial Sequence: Synthetic oligonucleotide
cgcagcggcctgcagctgagc

SEQ ID NO: 2996 - DNA, 21 bp, Artificial Sequence
  Description of Artificial Sequence: Synthetic oligonucleotide
cgccgcggcctgattctggcg

SEQ ID NO: 2997 - DNA, 21 bp, Artificial Sequence
  Description of Artificial Sequence: Synthetic oligonucleotide
cgccattgcctgccgaccctg

SEQ ID NO: 2998 - DNA, 21 bp, Artificial Sequence
  Description of Artificial Sequence: Synthetic oligonucleotide
cgcaacctgctgcatgataac

SEQ ID NO: 2999 - DNA, 21 bp, Artificial Sequence
  Description of Artificial Sequence: Synthetic oligonucleotide
cgcgcggcgctggatcgcctg

SEQ ID NO: 3000 - DNA, 12 bp, Artificial Sequence
  Description of Artificial Sequence: Synthetic oligonucleotide
cgcaaaaaactg

SEQ ID NO: 3001 - DNA, 12 bp, Artificial Sequence
  Description of Artificial Sequence: Synthetic oligonucleotide
cgccgccgcctg

SEQ ID NO: 3002 - DNA, 21 bp, Artificial Sequence
  Description of Artificial Sequence: Synthetic oligonucleotide
cgcgcgcgcctgtgcagcagc

SEQ ID NO: 3003 - DNA, 21 bp, Artificial Sequence
  Description of Artificial Sequence: Synthetic oligonucleotide
cgcctgccgctggtgccggaa

SEQ ID NO: 3004 - DNA, 21 bp, Artificial Sequence
  Description of Artificial Sequence: Synthetic oligonucleotide
cgcaaaaaactggtgctggaa

SEQ ID NO: 3005 - DNA, 21 bp, Artificial Sequence
  Description of Artificial Sequence: Synthetic oligonucleotide
cgcgaaaacctgcagcgcaaa

SEQ ID NO: 3006 - DNA, 21 bp, Artificial Sequence
  Description of Artificial Sequence: Synthetic oligonucleotide
cgccagccgctgagcgaagcg

SEQ ID NO: 3007 - DNA, 21 bp, Artificial Sequence
  Description of Artificial Sequence: Synthetic oligonucleotide
cgcacccagctggaaaccaaa

SEQ ID NO: 3008 - DNA, 21 bp, Artificial Sequence
  Description of Artificial Sequence: Synthetic oligonucleotide
cgcaacagcctgcgccagacc

SEQ ID NO: 3009 - DNA, 21 bp, Artificial Sequence
  Description of Artificial Sequence: Synthetic oligonucleotide
cgctatggcctgcatccggat

SEQ ID NO: 3010 - DNA, 33 bp, Artificial Sequence; identical to SEQ ID NO: 104
  Description of Artificial Sequence: Synthetic oligonucleotide

SEQ ID NO: 3011 - DNA, 15 bp, Artificial Sequence
  Description of Artificial Sequence: Synthetic oligonucleotide
gcgaaagaaaacgaa

SEQ ID NO: 3012 - DNA, 15 bp, Artificial Sequence
  Description of Artificial Sequence: Synthetic oligonucleotide
agcaaagaaaacgtg

SEQ ID NO: 3013 - DNA, 24 bp, Artificial Sequence
  Description of Artificial Sequence: Synthetic oligonucleotide
  misc_feature (1)..(3): This region may encompass "ctg" or "att" or "gtt" or "atg" or "ccg"
  modified_base (4)..(9): n is a, c, g, or t
  misc_feature (4)..(9): This region may encompass 0-2 "nnn" repeating units
  modified_base (16)..(21): n is a, c, g, or t
  misc_feature (22)..(24): This region may encompass "agc" or "acc"
nnnnnnnnnaccccgnnnnnnnnn

SEQ ID NO: 3014 - DNA, 24 bp, Artificial Sequence
  Description of Artificial Sequence: Synthetic oligonucleotide
ccgtttctgaccccgagcccggaa

SEQ ID NO: 3015 - DNA, 21 bp, Artificial Sequence
  Description of Artificial Sequence: Synthetic oligonucleotide
ccgggcaccccgccgagcagc

SEQ ID NO: 3016 - DNA, 21 bp, Artificial Sequence
  Description of Artificial Sequence: Synthetic oligonucleotide
ctgctgaccccgccgcagagc

SEQ ID NO: 3017 - DNA, 24 bp, Artificial Sequence
  Description of Artificial Sequence: Synthetic oligonucleotide
  misc_feature (1)..(3): This region may encompass "ctg" or "att" or "gtt" or "atg" or "ccg"
  modified_base (4)..(9): n is a, c, g, or t
  misc_feature (4)..(9): This region may encompass 0-2 "nnn" repeating units
  modified_base (16)..(21): n is a, c, g, or t
nnnnnnnnnaccccgnnnnnngaa

SEQ ID NO: 3018 - DNA, 24 bp, Artificial Sequence
  Description of Artificial Sequence: Synthetic oligonucleotide
ccgtttctgaccccgagcccggaa

SEQ ID NO: 3019 - DNA, 24 bp, Artificial Sequence
  Description of Artificial Sequence: Synthetic oligonucleotide
agcctgattccgaccccggataaa

SEQ ID NO: 3020 - DNA, 36 bp, Artificial Sequence; identical to SEQ ID NO: 109
  Description of Artificial Sequence: Synthetic oligonucleotide

SEQ ID NO: 3021 - DNA, 18 bp, Artificial Sequence
  Description of Artificial Sequence: Synthetic oligonucleotide
agcgatagcgaaccggat

SEQ ID NO: 3022 - DNA, 15 bp, Artificial Sequence
  Description of Artificial Sequence: Synthetic oligonucleotide
  modified_base (7)..(12): n is a, c, g, or t
accccgnnnnnngaa

SEQ ID NO: 3023 - DNA, 24 bp, Artificial Sequence
  Description of Artificial Sequence: Synthetic oligonucleotide
agcctgattccggaaccggatcgt

SEQ ID NO: 3024 - DNA, 21 bp, Artificial Sequence
  Description of Artificial Sequence: Synthetic oligonucleotide
agcggcgtggaaaccagcttt

SEQ ID NO: 3025 - DNA, 21 bp, Artificial Sequence
  Description of Artificial Sequence: Synthetic oligonucleotide
ctgaaactgaaaaaaagcctg

SEQ ID NO: 3026 - DNA, 15 bp, Artificial Sequence
  Description of Artificial Sequence: Synthetic oligonucleotide
agcggcctggatagc

SEQ ID NO: 3027 - DNA, 18 bp, Artificial Sequence
  Description of Artificial Sequence: Synthetic oligonucleotide
gatagcggcattgaaagc

SEQ ID NO: 3028 - DNA, 30 bp, Artificial Sequence
  Description of Artificial Sequence: Synthetic oligonucleotide
agcagccgcgatagcggccgcggcgatagc

SEQ ID NO: 3029 - DNA, 18 bp, Artificial Sequence
  Description of Artificial Sequence: Synthetic oligonucleotide
gatagcggcctgggcagc

SEQ ID NO: 3030 - DNA, 18 bp, Artificial Sequence
  Description of Artificial Sequence: Synthetic oligonucleotide
gaaccgcctctggaaccg

SEQ ID NO: 3031 - DNA, 36 bp, Artificial Sequence
  Description of Artificial Sequence: Synthetic oligonucleotide
  modified_base (1)..(3): n is a, c, g, or t
  misc_feature (4)..(6): This region may encompass "gtg" or "ctg" or "att" or "gcg"
  misc_feature (7)..(9): This region may encompass "gtg" or "ctg" or "att"
  misc_feature (22)..(24): This region may encompass "gtg" or "ctg" or "att"
  modified_base (25)..(30): n is a, c, g, or t
  modified_base (34)..(36): n is a, c, g, or t
nnnnnnnnnggttatccgccgnnnnnnnnncgtnnn

SEQ ID NO: 3032 - DNA, 36 bp, Artificial Sequence; identical to SEQ ID NO: 118
  Description of Artificial Sequence: Synthetic oligonucleotide

SEQ ID NO: 3033 - DNA, 36 bp, Artificial Sequence; identical to SEQ ID NO: 121
  Description of Artificial Sequence: Synthetic oligonucleotide

SEQ ID NO: 3034 - DNA, 39 bp, Artificial Sequence; identical to SEQ ID NO: 124
  Description of Artificial Sequence: Synthetic oligonucleotide

SEQ ID NO: 3035 - DNA, 39 bp, Artificial Sequence; identical to SEQ ID NO: 127
  Description of Artificial Sequence: Synthetic oligonucleotide

SEQ ID NO: 3036 - DNA, 39 bp, Artificial Sequence; identical to SEQ ID NO: 130
  Description of Artificial Sequence: Synthetic oligonucleotide

SEQ ID NO: 3037 - DNA, 12 bp, Artificial Sequence
  Description of Artificial Sequence: Synthetic oligonucleotide
cgtcgtcgtggt

SEQ ID NO: 3038 - DNA, 12 bp, Artificial Sequence
  Description of Artificial Sequence: Synthetic oligonucleotide
gacatcaacaac

SEQ ID NO: 3039 - DNA, 21 bp, Artificial Sequence
  Description of Artificial Sequence: Synthetic oligonucleotide
  modified_base (10)..(18): n is a, c, g, or t
  misc_feature (10)..(18): This region may encompass 2-3 "nnn" repeating units
  misc_feature (19)..(21): This region may encompass "agc" or "acc"
gatagcggcnnnnnnnnnnnn

SEQ ID NO: 3040 - DNA, 18 bp, Artificial Sequence
  Description of Artificial Sequence: Synthetic oligonucleotide
gatagcggcattggcacc

SEQ ID NO: 3041 - DNA, 18 bp, Artificial Sequence
  Description of Artificial Sequence: Synthetic oligonucleotide
gatgaaggcaactatgaa

SEQ ID NO: 3042 - DNA, 18 bp, Artificial Sequence
  Description of Artificial Sequence: Synthetic oligonucleotide
  modified_base (10)..(15): n is a, c, g, or t
gatagcggcnnnnnnagc

SEQ ID NO: 3043 - DNA, 27 bp, Artificial Sequence
  Description of Artificial Sequence: Synthetic oligonucleotide
agcgaaggcagcgatgatagcggcctg

SEQ ID NO: 3044 - DNA, 21 bp, Artificial Sequence
  Description of Artificial Sequence: Synthetic oligonucleotide
accgatagcggccgcggcagc

SEQ ID NO: 3045 - DNA, 18 bp, Artificial Sequence
  Description of Artificial Sequence: Synthetic oligonucleotide
gatagcggctataacacc

SEQ ID NO: 3046 - DNA, 21 bp, Artificial Sequence
  Description of Artificial Sequence: Synthetic oligonucleotide
tatagcggcaacctggaaagc

SEQ ID NO: 3047 - DNA, 42 bp, Artificial Sequence
  Description of Artificial Sequence: Synthetic oligonucleotide
agccagaccagcaccccgaccgatgtgaccgcgattcatctg

SEQ ID NO: 3048 - DNA, 21 bp, Artificial Sequence
  Description of Artificial Sequence: Synthetic oligonucleotide
ccgaccgatgtgaccgcgatt

SEQ ID NO: 3049 - DNA, 45 bp, Artificial Sequence; identical to SEQ ID NO: 142
  Description of Artificial Sequence: Synthetic oligonucleotide

SEQ ID NO: 3050 - DNA, 42 bp, Artificial Sequence
  Description of Artificial Sequence: Synthetic oligonucleotide
  misc_feature (1)..(3): This region may encompass "att" or "ctg"
  modified_base (10)..(33): n is a, c, g, or t
  misc_feature (10)..(33): This region may encompass 6-8 "nnn" repeating units
  misc_feature (34)..(36): This region may encompass "ttt" or "ctg" or "att" or "gtg" or "atg"
  modified_base (37)..(39): n is a, c, g, or t
  misc_feature (40)..(42): This region may encompass "ttt" or "ctg" or "att" or "gtg" or "atg"
nnngcgaccnnnnnnnnnnnnnnnnnnnnnnnnnnnnnnnnn

SEQ ID NO: 3051 - DNA, 42 bp, Artificial Sequence
  Description of Artificial Sequence: Synthetic oligonucleotide
  misc_feature (1)..(3): This region may encompass "cgt" or "aaa"
  misc_feature (4)..(6): This region may encompass "cgt" or "aaa"
  modified_base (7)..(9): n is a, c, g, or t
  modified_base (16)..(18): n is a, c, g, or t
  misc_feature (22)..(24): This region may encompass "ttt" or "cta" or "atg"
  modified_base (25)..(27): n is a, c, g, or t
  misc_feature (28)..(30): This region may encompass "cgt" or "aaa"
  misc_feature (34)..(36): This region may encompass "cgt" or "aaa" or "cat"
  modified_base (37)..(39): n is a, c, g, or t
  misc_feature (40)..(42): This region may encompass "cgt" or "aaa"
nnnnnnnnnagcctgnnntttnnnnnnnnncgtnnnnnnnnn

SEQ ID NO: 3052 - DNA, 24 bp, Artificial Sequence
  Description of Artificial Sequence: Synthetic oligonucleotide
gcaagccgtatggaagaagttgat

SEQ ID NO: 3053 - DNA, 24 bp, Artificial Sequence
  Description of Artificial Sequence: Synthetic oligonucleotide
ggtccgaccattgaagaagttgat

SEQ ID NO: 3054 - DNA, 60 bp, Artificial Sequence
  Description of Artificial Sequence: Synthetic oligonucleotide
gacatcaacaacaacaacaacatcgttgaagacgttgaacgtaaacgtgaattctacatc

SEQ ID NO: 3055 - DNA, 42 bp, Artificial Sequence
  Description of Artificial Sequence: Synthetic oligonucleotide
tctaaactgtctgttaacgcgccggaattctacccgtctggt

SEQ ID NO: 3056 - DNA, 18 bp, Artificial Sequence
  Description of Artificial Sequence: Synthetic oligonucleotide
atcggtctgctgggtggt

SEQ ID NO: 3057 - DNA, 12 bp, Artificial Sequence
  Description of Artificial Sequence: Synthetic oligonucleotide
ccgggtctgtgg

SEQ ID NO: 3058 - DNA, 33 bp, Artificial Sequence
  Description of Artificial Sequence: Synthetic oligonucleotide
accgcgccgccgccggcgtatgcgaccctgggc

SEQ ID NO: 3059 - DNA, 30 bp, Artificial Sequence
  Description of Artificial Sequence: Synthetic oligonucleotide
  modified_base (7)..(15): n is a, c, g, or t
  modified_base (19)..(27): n is a, c, g, or t
agcctgnnnnnnnnnctgnnnnnnnnnatt

SEQ ID NO: 3060 - DNA, 27 bp, Artificial Sequence
  Description of Artificial Sequence: Synthetic oligonucleotide
agccgcaccccgctgaccaccctgaac

SEQ ID NO: 3061 - DNA, 21 bp, Artificial Sequence
  Description of Artificial Sequence: Synthetic oligonucleotide
gatggctataccccggaaccg

SEQ ID NO: 3062 - DNA, 27 bp, Artificial Sequence
  Description of Artificial Sequence: Synthetic oligonucleotide
cgcccgaccgcggcggtgaccccgatt

SEQ ID NO: 3063 - DNA, 21 bp, Artificial Sequence
  Description of Artificial Sequence: Synthetic oligonucleotide
gatgaacagtttgtgccggat

SEQ ID NO: 3064 - DNA, 42 bp, Artificial Sequence
  Description of Artificial Sequence: Synthetic oligonucleotide
ctggcgccgtatattccgatggatggcgaagattttcagctg

SEQ ID NO: 3065 - DNA, 63 bp, Artificial Sequence
  Description of Artificial Sequence: Synthetic oligonucleotide
tatgtgggcctggtgtggggcgtgctgctgaccaccgaactgattgtgtgggcggcgagcgcg

SEQ ID NO: 3066 - DNA, 36 bp, Artificial Sequence
  Description of Artificial Sequence: Synthetic oligonucleotide
ccgaaaaccccgccgagcagctgcgatagcaccaac

SEQ ID NO: 3067 - DNA, 18 bp, Artificial Sequence
  Description of Artificial Sequence: Synthetic oligonucleotide
  misc_feature (1)..(3): This region may encompass "gat" or "aac"
  modified_base (4)..(6): n is a, c, g, or t
  misc_feature (10)..(12): This region may encompass "agc" or "acc"
  modified_base (13)..(15): n is a, c, g, or t
nnnnnntatnnnnnnccg

SEQ ID NO: 3068 - DNA, 30 bp, Artificial Sequence
  Description of Artificial Sequence: Synthetic oligonucleotide
cgcgcgattgataaccagtataccccgctg

SEQ ID NO: 3069 - DNA, 36 bp, Artificial Sequence
  Description of Artificial Sequence: Synthetic oligonucleotide
attcgcggcagcaacgaatataccgaaggcccgagc

SEQ ID NO: 3070 - DNA, 36 bp, Artificial Sequence
  Description of Artificial Sequence: Synthetic oligonucleotide
attcgcaacaccaacgaatataccgaaggcccgacc

SEQ ID NO: 3071 - DNA, 33 bp, Artificial Sequence
  Description of Artificial Sequence: Synthetic oligonucleotide
catgtggaaaacgattatattgataacccgagc

SEQ ID NO: 3072 - DNA, 30 bp, Artificial Sequence
  Description of Artificial Sequence: Synthetic oligonucleotide
agctttaacccgtatgaaccggaactggcg

SEQ ID NO: 3073 - DNA, 36 bp, Artificial Sequence
  Description of Artificial Sequence: Synthetic oligonucleotide
accctgaacagcgatggctataccccggaaccggcg

SEQ ID NO: 3074 - DNA, 33 bp, Artificial Sequence
  Description of Artificial Sequence: Synthetic oligonucleotide
attccgtttctggattatcgcacctatgcggtg

SEQ ID NO: 3075 - DNA, 33 bp, Artificial Sequence
  Description of Artificial Sequence: Synthetic oligonucleotide
attccgtttctggattatcgcacctatgcgatg

SEQ ID NO: 3076 - DNA, 36 bp, Artificial Sequence
  Description of Artificial Sequence: Synthetic oligonucleotide
agcatttttaacagcctgtataccaccctgagcgat

SEQ ID NO: 3077 - DNA, 36 bp, Artificial Sequence; identical to SEQ ID NO: 3076
  Description of Artificial Sequence: Synthetic oligonucleotide

SEQ ID NO: 3078 - DNA, 36 bp, Artificial Sequence
  Description of Artificial Sequence: Synthetic oligonucleotide
aaaggcgatggcggcctgtatagcagcctgccgccg

SEQ ID NO: 3079 - DNA, 24 bp, Artificial Sequence
  Description of Artificial Sequence: Synthetic oligonucleotide
tctgaccagatcgttccggaatac

SEQ ID NO: 3080 - DNA, 27 bp, Artificial Sequence
  Description of Artificial Sequence: Synthetic oligonucleotide
cgcccgaccgcggcggtgaccccgatt

SEQ ID NO: 3081 - DNA, 24 bp, Artificial Sequence
  Description of Artificial Sequence: Synthetic oligonucleotide
  misc_feature (1)..(3): This region may encompass "gaa" or "gac"
  misc_feature (4)..(6): This region may encompass "gaa" or "gac"
  modified_base (7)..(15): n is a, c, g, or t
  misc_feature (7)..(15): This region may encompass 6 or 9 nucleotides
  misc_feature (22)..(24): This region may encompass "gaa" or "gac"
nnnnnnnnnnnnnnngtgccgnnn

SEQ ID NO: 3082 - DNA, 24 bp, Artificial Sequence
  Description of Artificial Sequence: Synthetic oligonucleotide
agcgatcagattgtgccggaatat

SEQ ID NO: 3083 - DNA, 27 bp, Artificial Sequence
  Description of Artificial Sequence: Synthetic oligonucleotide
  modified_base (1)..(3): n is a, c, g, or t
  modified_base (7)..(9): n is a, c, g, or t
  modified_base (13)..(15): n is a, c, g, or t
  modified_base (19)..(21): n is a, c, g, or t
  modified_base (25)..(27): n is a, c, g, or t
  misc_feature (25)..(27): This region may encompass any codon except "ccn"
nnnccgnnngcgnnngtgnnnccgnnn

SEQ ID NO: 3084 - DNA, 27 bp, Artificial Sequence
  Description of Artificial Sequence: Synthetic oligonucleotide
aaaccgaccgcgtatgtgcgcccgatg

SEQ ID NO: 3085 - DNA, 27 bp, Artificial Sequence
  Description of Artificial Sequence: Synthetic oligonucleotide
aaaccggcggcggtggtggcgccgatt

SEQ ID NO: 3086 - DNA, 27 bp, Artificial Sequence
  Description of Artificial Sequence: Synthetic oligonucleotide
gcgccgaccgcggtggtgctgccgcat

SEQ ID NO: 3087 - DNA, 27 bp, Artificial Sequence
  Description of Artificial Sequence: Synthetic oligonucleotide
ccgccgcgcgcgctggtgctgccgcat

SEQ ID NO: 3088 - DNA, 48 bp, Artificial Sequence
  Description of Artificial Sequence: Synthetic oligonucleotide
gcgtgcaaaaactggtttagcagcctgagccattttgtgattcatctg

SEQ ID NO: 3089 - DNA, 30 bp, Artificial Sequence
  Description of Artificial Sequence: Synthetic oligonucleotide
gaactgtacccgctgacctctctgcgttct

SEQ ID NO: 3090 - DNA, 18 bp, Artificial Sequence
  Description of Artificial Sequence: Synthetic oligonucleotide
  modified_base (4)..(12): n is a, c, g, or t
gaannnnnnnnnctgctg

SEQ ID NO: 3091 - DNA, 12 bp, Artificial Sequence
  Description of Artificial Sequence: Synthetic oligonucleotide
  modified_base (4)..(9): n is a, c, g, or t
tatnnnnnnctg

SEQ ID NO: 3092 - DNA, 60 bp, Artificial Sequence
  Description of Artificial Sequence: Synthetic oligonucleotide
agccgcgaaaaaccgtataaagaagtgaccgaagatctgctgcatctgaacagcctgttt

SEQ ID NO: 3093 - DNA, 54 bp, Artificial Sequence
  Description of Artificial Sequence: Synthetic oligonucleotide
gcggcgggcgcgtatgatccggcgcgcaaactgctggaacagtatgcgaaaaaa

SEQ ID NO: 3094 - DNA, 15 bp, Artificial Sequence
  Description of Artificial Sequence: Synthetic oligonucleotide
aaatttgaacgccag

SEQ ID NO: 3095 - DNA, 15 bp, Artificial Sequence
  Description of Artificial Sequence: Synthetic oligonucleotide
cagcgcttttttgaa

SEQ ID NO: 3096 - DNA, 45 bp, Artificial Sequence
  Description of Artificial Sequence: Synthetic oligonucleotide
accgcgtctgacgactctgacatcgttaccctggaaccgccgaaa

SEQ ID NO: 3097 - DNA, 36 bp, Artificial Sequence
  Description of Artificial Sequence: Synthetic oligonucleotide
gaagttcgtgaccgtatgtggctgaaaatcaccatc

SEQ ID NO: 3098 - protein, 15 aa, Artificial Sequence
  Description of Artificial Sequence: Synthetic peptide
DYQRAIEYYQRALEL

SEQ ID NO: 3099 - DNA, 15 bp, Artificial Sequence
  Description of Artificial Sequence: Synthetic oligonucleotide
  misc_feature (1)..(3): This region may encompass "gcg" or "ccg"
  misc_feature (7)..(9): This region may encompass "atg" or "gtg"
  misc_feature (10)..(12): This region may encompass "att" or "atg"
nnnccgnnnnnngtg

SEQ ID NO: 3100 - protein, 6 aa, artificial
  synthetic
VGNIVT

SEQ ID NO: 3101 - protein, 11 aa, artificial
  synthetic
VSGWRLFKKIS

The invention claimed is:

1. A method of producing a chimeric protein comprising:
providing a first nucleic acid encoding first and second repeat domains linked by inter-repeat loops; and
combining said first nucleic acid, a second nucleic acid encoding a first binding domain that binds to a first target molecule and a third nucleic acid encoding a second binding domain that binds to a second target molecule to generate a chimeric nucleic acid encoding a chimeric protein comprising said first and said second repeat domains linked by inter-repeat loops and said first and second binding domains, where said first and said second binding domains are, independently, located in an inter-repeat loop or comprise the N and/or C terminus of the chimeric protein; and
expressing said chimeric nucleic acid to produce the chimeric protein.

2. The method of claim 1, wherein said chimeric protein comprises helix-turn-helix repeat domains.

3. The method of claim 2, wherein said chimeric protein comprises tetratricopeptide (TPR) repeat domains.

4. The method of claim 3, wherein a TPR repeat domain comprises the amino acid sequence Y-$X_1X_2X_3X_4$;
wherein Y is an amino acid sequence of a repeat domain selected from the group of sequences presented in Tables 4 to 6 or a variant thereof and $X_1$, $X_2$, $X_3$, $X_4$ are independently any amino acid.

5. The method of claim 4, wherein Y—$X_1X_2X_3X_4$ comprises the amino acid sequence;
AEAWYNLGNAYYKQGDYQKAIEYYQKALEL-$X_1X_2X_3X_4$; or
AEALNNLGNVYREQGDYQKAIEYYQKALEL-$X_1X_2X_3X_4$; or
AEAWYNLGNAYYKQGDYQKAIEYYQKALEL-$X_1X_2X_3X_4$; or
AEALNNLGNVYREQGDYQRAIEYYQRALEL-$X_1X_2X_3X_4$; or
AEALRNLGRVYRRQGRYQRAIEYYRRALEL-$X_1X_2X_3X_4$;
wherein $X_1$, $X_2$, $X_3$, $X_4$ are independently any amino acid, and optionally wherein $X_1$ is D and/or wherein $X_2$ is P.

6. The method of claim 1, wherein said chimeric protein comprises 2-5 repeat domains.

7. The method of claim 1, wherein said first and said second binding domains are independently located in first and second inter-repeat loops.

8. The method of claim 1, wherein a binding domain comprises the N terminus or a binding domain comprising the C terminus or wherein said first and second binding domains independently comprise the N and C termini.

9. The method of claim 8, wherein the binding domain comprising the N-terminus comprises an α helix, the binding domain comprising the C-terminus comprises an α helix the binding domains comprising the N and C termini comprise an α helix.

10. The method of claim 9, wherein the binding domain comprising the N-terminus comprises the sequence $X_n$-XY-XXXIXXYXXXLXX-$X_1X_2$XX, where residues denoted by X are independently any amino acid, $X_1$ and $X_2$ are independently any amino acid and n is 0 or any number, and optionally wherein $X_1$ is D and/or wherein $X_2$ is P.

11. The method of claim 2, wherein the binding domain comprising the C-terminus comprises the sequence $X_1X_2$XX-XXAXXXLXX[AV]XXXXX-$X_n$, where residues denoted by X are independently any amino acid, $X_1$, and $X_2$ are independently any amino acid n is 0 or any number, and optionally wherein $X_1$ is D and/or wherein $X_2$ is P.

12. The method of claim 1, wherein said first binding domain of said chimeric protein binds a target molecule selected from the group consisting of: β-catenin, KRAS, tankyrase, c-myc, n-myc, ras, notch and aurora A, α-synuclein, β-amyloid, tau, superoxide dismutase, huntingtin, oncogenic histone deacetylase, and oncogenic histone methyltransferase.

13. The method of claim 1, wherein said second binding domain of said chimeric protein binds an E3 ubiquitin ligase.

14. The method of claim 13, wherein said chimeric protein comprises
(i) an N terminal peptide ligand that binds a target protein and a C terminal peptide ligand that binds an E3 ubiquitin ligase, or
(ii) an inter-repeat peptide ligand that binds a target protein and a C terminal peptide ligand that binds an E3 ubiquitin ligase, or
(iii) an inter-repeat peptide ligand that binds a target protein and an N terminal peptide ligand that binds an E3 ubiquitin ligase, or
(iv) a C terminal domain that binds a target protein and an N terminal peptide ligand that binds an E1 ubiquitin ligase, or
(v) an inter-repeat binding domain that binds an E3 ubiquitin ligase and an N terminal binding domain that binds a target protein, or
(vi) an inter-repeat binding domain that binds an E3 ubiquitin ligase and a C terminal binding.

15. The method of claim 1, wherein said chimeric protein further comprises a linker linking an inter-repeat loop to a binding domain.

16. The method of claim 1, wherein each of said first and said second binding domain of said chimeric protein is, independently, non-hydrophobic.

* * * * *

UNITED STATES PATENT AND TRADEMARK OFFICE
CERTIFICATE OF CORRECTION

PATENT NO. : 11,279,925 B2
APPLICATION NO. : 16/282155
DATED : March 22, 2022
INVENTOR(S) : Laura Itzhaki It is certified that error appears in the above-identified patent and that said Letters Patent is hereby corrected as shown below:

In the Claims

At Column 139, Claim number 4, Line number 35, please remove the "-" between "domain" and "comprises"

At Column 140, Claim number 9, Line number 14, please add a --,-- between "helix" and "the"

At Column 140, Claim number 11, Line number 24, please replace "claim 2" with --claim 9--

Signed and Sealed this
Ninth Day of August, 2022

Katherine Kelly Vidal
*Director of the United States Patent and Trademark Office*